United States Patent
Freier et al.

(10) Patent No.: US 11,279,932 B2
(45) Date of Patent: Mar. 22, 2022

(54) MODULATORS OF MALAT1 EXPRESSION

(71) Applicant: Ionis Pharmaceuticals, Inc., Carlsbad, CA (US)

(72) Inventors: Susan M. Freier, San Diego, CA (US); Youngsoo Kim, San Diego, CA (US); Robert MacLeod, San Diego, CA (US)

(73) Assignee: IONIS PHARMACEUTICALS, INC., Carlsbad, CA (US)

(*) Notice: Subject to any disclaimer, the term of this patent is extended or adjusted under 35 U.S.C. 154(b) by 0 days.

(21) Appl. No.: 16/803,723

(22) Filed: Feb. 27, 2020

(65) Prior Publication Data

US 2020/0277604 A1 Sep. 3, 2020

Related U.S. Application Data

(60) Provisional application No. 62/950,812, filed on Dec. 19, 2019, provisional application No. 62/811,460, filed on Feb. 27, 2019.

(51) Int. Cl.
*C07H 21/04* (2006.01)
*C12N 15/113* (2010.01)

(52) U.S. Cl.
CPC ........ *C12N 15/113* (2013.01); *C12N 2310/11* (2013.01); *C12N 2310/315* (2013.01); *C12N 2310/321* (2013.01); *C12N 2310/341* (2013.01)

(58) Field of Classification Search
None
See application file for complete search history.

(56) References Cited

U.S. PATENT DOCUMENTS

| | | |
|---|---|---|
| 3,687,808 A | 8/1972 | Merigan et al. |
| 4,415,732 A | 11/1983 | Caruthers et al. |
| 4,458,066 A | 7/1984 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,668,777 A | 5/1987 | Caruthers et al. |
| 4,725,677 A | 2/1988 | Koster et al. |
| 4,845,205 A | 7/1989 | Dinh et al. |
| 4,973,679 A | 11/1990 | Caruthers et al. |
| 4,981,957 A | 1/1991 | Lebleu et al. |
| 5,013,830 A | 5/1991 | Ohutsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,185,444 A | 12/1993 | Summerton et al. |
| 5,276,019 A | 1/1994 | Cohen et al. |
| 5,278,302 A | 1/1994 | Caruthers et al. |
| 5,286,717 A | 2/1994 | Cohen et al. |
| 5,319,080 A | 6/1994 | Leumann |
| 5,321,131 A | 6/1994 | Agrawal et al. |
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |

(Continued)

FOREIGN PATENT DOCUMENTS

| | | |
|---|---|---|
| WO | WO 1998/39352 | 9/1998 |
| WO | WO 1999/014226 | 3/1999 |

(Continued)

OTHER PUBLICATIONS

Kim, Jongchan, et al. "Long noncoding RNA MALAT1 suppresses breast cancer metastasis." Nature genetics 50.12 (2018): 1705-1715.*

Sun, Yutong, and Li Ma. "New insights into long non-coding RNA MALAT1 in cancer and metastasis." Cancers 11.2 (2019): 216.*

Albaek et al., "Analogues of a Locked Nucleic Acid with Three-Carbon 2',4'-Linkages: Synthesis by Ring-Closing Metathesis and Influence of Nucleic Acid Duplex Stability" J. Org. Chem. (2006) 71:7731-7740.

Allshire, "Molecular biology. RNAi and heterochromatin—a hushed-up affair" Science (2002) 297(5588):1818-1819.

Altmann et al., "Second Generation Antisense Oligonucleotides—Inhibition of PKC-α and c-raf Kinase Expression by Chimeric Oligonucleotides Incorporating 6"-Substituted Carbocyclic Nucleosides and 2"-O-Ethylene Glycol Substituted Ribonucleosides" Nuclewsodies Nucleotides. (1997) 16:917-926.

Altmann et al., "Second Generation of Antisense Oligonucleotides: From Nuclease Resistance to Biological Efficacy in Animals" Chimia. (1996) 50(4):168-176.

(Continued)

*Primary Examiner* — Kimberly Chong

(74) *Attorney, Agent, or Firm* — Morgan, Lewis & Bockius LLP

(57) ABSTRACT

The present embodiments provide methods, compounds, and compositions useful for inhibiting MALAT1 expression, which may be useful for treating, preventing, or ameliorating a cancer associated with MALAT1.

8 Claims, No Drawings

Specification includes a Sequence Listing.

(56) References Cited

U.S. PATENT DOCUMENTS

| | | |
|---|---|---|
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,166,199 A | 12/2000 | Cook et al. |
| 6,268,490 B1 | 7/2001 | Imanishi et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,670,461 B1 | 12/2003 | Wengel et al. |
| 6,770,748 B2 | 8/2004 | Imanishi et al. |
| 6,794,499 B2 | 9/2004 | Wengel et al. |
| 6,906,182 B2 | 6/2005 | Ts'o et al. |
| 7,015,315 B1 | 3/2006 | Cook et al. |
| 7,034,133 B2 | 4/2006 | Wengel et al. |
| 7,053,207 B2 | 5/2006 | Wengel et al. |
| 7,101,993 B1 | 9/2006 | Cook et al. |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,572,582 B2 | 8/2009 | Wengel et al. |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,875,733 B2 | 1/2011 | Bhat et al. |
| 7,939,677 B2 | 5/2011 | Bhat et al. |
| 8,022,193 B2 | 9/2011 | Swayze et al. |
| 8,030,467 B2 | 10/2011 | Seth et al. |
| 8,034,909 B2 | 10/2011 | Wengel et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,127,276 B2 | 8/2015 | Prakash et al. |
| 9,290,760 B2 | 3/2016 | Rajeev et al. |
| 9,546,368 B2 | 1/2017 | Bennett et al. |
| 2001/0053519 A1 | 12/2001 | Fodor et al. |
| 2003/0082807 A1 | 5/2003 | Wengel |
| 2003/0158403 A1 | 8/2003 | Manoharan et al. |
| 2003/0175906 A1 | 9/2003 | Manoharan et al. |
| 2003/0207841 A1 | 11/2003 | Kaneko et al. |
| 2003/0224377 A1 | 12/2003 | Wengel et al. |
| 2003/0228597 A1 | 12/2003 | Cowsert et al. |
| 2004/0143114 A1 | 7/2004 | Imanishi et al. |
| 2004/0171570 A1 | 9/2004 | Allerson et al. |
| 2004/0192918 A1 | 9/2004 | Imanishi et al. |
| 2005/0130923 A1 | 6/2005 | Bhat et al. |
| 2005/0255487 A1 | 11/2005 | Khvorova et al. |
| 2006/0148740 A1 | 7/2006 | Platenburg |
| 2007/0031844 A1 | 2/2007 | Khvorova et al. |
| 2007/0172853 A1 | 7/2007 | McCarroll et al. |
| 2008/0039618 A1 | 2/2008 | Allerson et al. |
| 2009/0012281 A1 | 1/2009 | Swayze et al. |
| 2009/0239816 A1 | 9/2009 | Rivory et al. |
| 2010/0190837 A1 | 7/2010 | Migawa et al. |
| 2010/0197762 A1 | 8/2010 | Swayze et al. |

(56) References Cited

U.S. PATENT DOCUMENTS

| | | | |
|---|---|---|---|
| 2011/0123520 | A1 | 5/2011 | Manoharan et al. |
| 2011/0301052 | A1 | 12/2011 | McNeel et al. |
| 2012/0021515 | A1 | 1/2012 | Swayze et al. |
| 2013/0130378 | A1 | 5/2013 | Manoharan et al. |
| 2013/0203836 | A1 | 8/2013 | Rajeev et al. |
| 2014/0107330 | A1 | 4/2014 | Freier et al. |
| 2014/0371296 | A1 | 12/2014 | Bennett et al. |
| 2015/0018540 | A1 | 1/2015 | Prakash et al. |
| 2015/0184153 | A1 | 7/2015 | Freier et al. |
| 2015/0191727 | A1 | 7/2015 | Migawa et al. |
| 2015/0267195 | A1 | 9/2015 | Seth et al. |
| 2015/0275212 | A1 | 10/2015 | Albaek et al. |

FOREIGN PATENT DOCUMENTS

| | | |
|---|---|---|
| WO | WO 2000/63364 | 10/2000 |
| WO | WO 2001/049687 | 7/2001 |
| WO | WO 2003/004602 | 1/2003 |
| WO | WO 2004/035765 | 10/2003 |
| WO | WO 2004/011624 | 2/2004 |
| WO | WO 2004/106356 | 12/2004 |
| WO | WO 2005/021570 | 3/2005 |
| WO | WO 2005/121371 | 12/2005 |
| WO | WO 2006/047842 | 5/2006 |
| WO | WO 2007/134181 | 11/2007 |
| WO | WO 2008/101157 | 8/2008 |
| WO | WO 2008/150729 | 12/2008 |
| WO | WO 2008/154401 | 12/2008 |
| WO | WO 2009/006478 | 1/2009 |
| WO | WO 2009/067647 | 5/2009 |
| WO | WO 2009/100320 | 8/2009 |
| WO | WO 2010/036696 | 4/2010 |
| WO | WO 2010/036698 | 4/2010 |
| WO | WO 2011/017521 | 2/2011 |
| WO | WO 2011/139702 | 11/2011 |
| WO | WO 2012/012467 | 1/2012 |
| WO | WO 2012/018881 | 2/2012 |
| WO | WO 2016/073828 | 5/2016 |
| WO | WO 2016/138017 | 9/2016 |
| WO | WO 2018/191153 | 10/2018 |
| WO | WO 2019/099781 | 5/2019 |
| WO | WO2020176771 | 9/2020 |

OTHER PUBLICATIONS

Altmann et al., "Second-generation antisense oligonucleotides: structure—activity relationships and the design of improved signal-transduction inhibitors" Biochem, Soc. Trans. (1996) 24:630-637.

Altschul et al., "Basic Local Alignment Search Tool" J. Mol. Biol. (1990) 215:403-410.

Arun et al., "Differentiation of mammary tumors and reduction in metastasis upon Malat1 lncRNA loss" Genes & Development (2015) 30: 34-51.

Baker et al., "2'-O-(2-Methoxy)ethyl-modified Anti-intercellular Adhesion Molecule 1 (ICAM-1) Oligonucleotides Selectively Increase the ICAM-1 mRNA Level and Inhibit Formation of the ICAM-1 Translation Initiation Complex in Human Umbilical Vein Endothelial Cells" J. Biol. Chem. (1997) 272:11994-12000.

Bernard et al., "A long nuclear-retained non-coding RNA regulates synaptogenesis by modulating gene expression" EMBO J. (2010) 29: 3082-3093.

Braasch et al., "Locked nucleic acid (LNA): fine-tuning the recognition of DNA and RNA" Chem. Biol. (2001) 8:1-7.

Braasch et al., "Novel antisense and peptide nucleic acid strategies for controlling gene expression" Biochemistry (2002) 41(14):4503-4510.

Branch et al., "A good antisense molecule is hard to find," TIBS (1998) 23:45-50.

CHIN "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

Crooke et al., "Basic Principles of Antisense Therapeutics" Antisense Research and Application (1998) Chapter 1:1-50.

Crooke et al., "Pharmacokinetic Properties of Several Novel Oligonucleotide Analogs in mice" J. Pharmacol. Exp. Ther. (1996) 277(2):923-937.

Crooke, ST., et al., "Antisense Drug Technology" Second Edition, CRC Press (2008) Chapters 1-28.

Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.

Elayadi et al., "Application of PNA and LNA oligomers to chemotherapy" Curr. Opinion Invens. Drugs (2001) 2:558-561.

Feng et al., "Expression of long non-coding ribonucleic acid metastasis-associated lung adenocarcinoma transcript-1 is correlated with progress and apoptosis of laryngeal squamous cell carcinoma" Head Neck Oncol. (2012) 4:46.

Freier et al., "The ups and downs of nucleic acid duplex stability: structure-stability studies on chemically-modified DNA:RNA duplexes" Nucleic Acids Research (1997) 25(22):4429-4443.

Frieden et al., "Expanding the design horizon of antisense oligonucleotides with alpha-L-LNA" Nucleic Acids Research (2003) 31(21):6365-6372.

Gautschi et al., "Activity of a novel bcl-2/bcl-xLbispecific antisense oligonucleotide against tumors of diverse histologic origins" J. Natl. Cancer Inst. (2001) 93:463-471.

Gu et al., "Base pairing properties of D- and L-cyclohexene nucleic acids (CeNA)" Oligonucleotides (2003) 13(6):479-489.

Gu et al., "Enzymatic resolution and base pairing properties of D- and L-cyclohexenyl nucleic acids (CeNA)" Nucleosides Nucleotides Nucleic Acids (2005) 24(5-7):993-998.

Gu et al., "Synthesis of enantiomeric-pure cyclohexenyl nucleoside building blocks for oligonucleotide synthesis" Tetrahedron (2004) 60(9):2111-2123.

Guo et al., "Inhibition of metastasis-associated lung adenocarcinoma transcript 1 in CaSki human cervical cancer cells suppresses cell proliferation and invasion" Acta Biochimica et Biophysica Sinica (2010) 42(3): 224-229.

Hall et al., "Establishment and maintenance of a heterochromatin domain" Science (2002) 297(5590):2232-2237.

Horvath et al., "Stereoselective synthesis of (−)-ara-cyclohexenyl-adenine" Tetrahedron Letters (2007) 48:3621-3623.

Hung et al. "Characterization of Target mRNA Reduction Through In Situ RNA Hybridization in Multiple Organ Systems Following Systematic Antizense Treatment in Animals" Nuc Acid Res (2013) 23: 369-378.

International Search Report for application PCT/US12/71371 dated Apr. 2, 2013.

Jadaliha et al., "Functional and prognostic significance of long non-coding RNA MALAT1 as a metastasis driver in ER negative lymph node negative breast cancer" Oncotarget (2016) 7: 40418-40436.

Jenuwein, "Molecular biology. An RNA-guided pathway for the epigenome" Science (2002) 297(5590):2215-2218.

Jones et al., "RNA quantitation by fluorescence-based solution assay: RiboGreen reagent characterization" Analytical Biochemistry (1998) 265(2):368-374.

Kabanov et al., "A new class of antivirals: antisense oligonucleotides combined with a hydrophobic substituent effectively inhibit influenza virus reproduction and synthesis of virus-specific proteins in MDCK cells" FEBS Lett. (1990) 259:327.

Koshkin et al., "LNA (locked nucleic acids): Synthesis of the adenine, cytosine, guanine, 5-methylcytosine, thymine and uracil bicyclonucleoside monomers, oligomerisation, and unprecedented nucleic acid recognition" Tetrahedron (1998) 54:3607-3630.

Kumar et al., "The first analogues of LNA (locked nucleic acids): phosphorothioate-LNA and 2'-thio-LNA" Bioorg Med Chem Lett. (1998) 8:2219-2222.

Lai et al., "Long non-coding RNA MALAT-1 overexpression predicts tumor recurrence of hepatocellular carcinoma after liver transplantation." Med. Oncol. (2012) 29(3): 1810-1816.

(56) References Cited

OTHER PUBLICATIONS

Letsinger et al., "Cholesteryl-conjugated oligonucleotides: Synthesis, properties, and activity as inhibitors of replication of human immunodeficiency virus in cell culture" PNAS (1989) 86:6553-6556.
Leumann et al., "DNA Analogues: From Supramolecular Principles to Biological Properties" Bioorganic & Medicinal Chemistry (2002) 10:841-854.
Maher et al., "Comparative hybrid arrest by tandem antisense oligodeoxyribonucleotides or oligodeoxyribonucleoside methylphosphonates in a cell-free system" Nucl. Acid. Res. (1988) 16(8):3341-3358.
Manoharan et al., "Chemical Modifications to Improve Uptake and Bioavailability of Antisense Oligonucleotides" Ann. N.Y. Acad. Sci. (1992) 660: 306-309.
Manoharan et al., "Cholic Acid-Oligonucleotide Conjugates for Antisense Applications" Bioorg. Med. Chem. Lett. (1994) 4:1053-1060.
Manoharan et al., "Introduction of a Lipophilic Thioether Tether in the Minor Groove of Nucleic Acids for Antisense Applications" Bioorg. Med. Chem. Lett. (1993) 3(12):2765-2770.
Manoharan et al., "Lipidic Nucleic Acids" Tetrahedron Lett. (1995) 36(21):3651-3654.
Manoharan et al., "Oligonucleotide Conjugates: Alteration of the Pharmacokinetic Properties of Antisense Agents" Nucleosides & Nucleotides (1995) 14(3-5):969-973.
Martin, "New acces to 2'-O-alkylated ribonucleosides and properties of 2'-O-alkylated oligoribonucleotides" Helv. Chim. Acta. (1995) 78:486-504.
Michalik et al., "Long Noncoding RNA MALAT1 Regulates Endothelial Cell Function and Vessel Growth" Circ. Res. (2014) 114: 1389-1397.
Mishra et al., "Improved leishmanicidal effect of phosphorotioate antisense oligonucleotides by LDL-mediated delivery" Biochim. Biophys. Acta (1995) 1264:229-237.
Moolenbeek et al., "The "Swiss roll": a simple technique for histological studies of the rodent intestine" Lab Anim. (1981) 15(1):57-59.
Moser et al., "ApcMin, a mutation in the murine Apc gene, predisposes to mammary carcinomas and focal alveolar hyperplasias" Proc. Natl. Acad. Sci. (1993) 90(19):8977-8981.
Nakagawa et al., "Malat1 is not an essential component of nuclear speckles in mice" RNA (2012) 18: 1487-1499.
Nauwelaerts et al., "Cyclohexenyl nucleic acids: conformationally flexible oligonucleotides" Nucleic Acids Res. (2005) 33(8):2452-2463.
Nauwelaerts et al., "Structural characterization and biological evaluation of small interfering RNAs containing cyclohexenyl nucleosides" J. Am. Chem. Soc. (2007) 129(30):9340-9348.
New England Biolabs 1998/99 Catalog (cover page and pp. 121 and 284).
Oberhauser et al., "Effective incorporation of 2'-O-methyl-oligoribonucleotides into liposomes and enhanced cell association through modifications with thiocholesterol" Nucl. Acids Res. (1992) 20(3):533-538.
Orum et al., "Locked nucleic acids: A promising molecular family for gene-function analysis and antisense drug development" Curr. Opinion Mol. Ther. (2001) 3:239-243.
Pal-Bhadra et al., "Heterochromatic silencing and HP1 localization in Drosophila are dependent on the RNAi machinery" Science (2004) 303(5658):669-672.
Park et al., "Diethylnitrosamine (DEN) induces irreversible hepatocellular carcinogenesis through overexpression of G1/S-phase regulatory proteins in rat" Toxicol. Lett. (2009) 191:321-326.
Perez-Soler et al., "Response and Determinants of Sensitivity to Paclitaxel in Human Non-Small Cell Lung Cancer Tumors Heterotransplanted in Nude Mice," Clinical Cancer Research (2000) 6: 4932-4938.
Reynolds et al., "Rational siRNA design for RNA interference" Nature Biotechnology (2004) 22(3):326-330.
Robeyns et al., "Oligonucleotides with cyclohexene-nucleoside building blocks: crystallization and preliminary X-ray studies of a left-handed sequence GTGTACAC" Acta. Crystallogr. Sect. F. Struct. Biol. Cryst. Commun. (2005) 61(Pt 6):585-586.
Robeyns et al., "Structure of the fully modified left-handed cyclohexene nucleic acid sequence GTGTACAC" J. Am. Chem. Soc. (2008) 130(6): 1979-1984.
Saison-Behmoaras et al., "Short modified antisense oligonucleotides directed against Ha-ras point mutation induce selective cleavage of the mRNA and inhibit T24 cells proliferation" EMBO J. (1991) 10(5):1111-1118.
Sanghvi et al., "Heterocyclic Base Modifications in Nucleic Acids and Their Applications in Antisense Oligonucleotides" Antisense Research and Applications (1993) pp. 273-288.
Schmidt et al., "The long non-coding MALAT-1 RNA indicates a poor prognosis in Non-small Cell Lung Cancer and induces migration and tumor growth" Journal of Thoracic Oncology (2011) 6(12): 1984-1992.
Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.
Shea et al., "Synthesis, hybridization properties and antiviral activity of lipid-oligodeoxynucleotide conjugates" Nucl. Acids Res. (1990) 18(13):3777-3783.
Singh et al., "LNA (locked nucleic acids): synthesis and high-affinity nucleic acid recognition" Chem. Commun. (1998) 455-456.
Singh et al., "Synthesis of 2'-amino-LNA: A novel conformationally restricted high-affinity oligonucleotide analogue with a handle" J. Org. Chem. (1998) 63: 10035-10039.
Smith et al., "Comparison of biosequences" Adv. Appl. Math. (1981) 2(4):482-489.
Srivastava et al., "Five- and Six-Membered Conformationally Locked 2',4'-Carbocyclic ribo-Thymidines: Synthesis, Structure, and Biochemical Studies" J. Am. Chem. Soc. (2007) 129(26):8362-8379.
St-Pierre et al., "Synthesis and biological evaluation of sialyl-oligonucleotide conjugates targeting leukocyte B trans-membranal receptor CD22 as delivery agents for nucleic acid drugs" Bioorg Med Chim (2016) 24: 2397-2409.
Svinarchuk et al., "Inhibition of HIV proliferation in MT-4 cells by antisense oligonucleotide conjugated to lipophilic groups" Biochimie (1993) 75:49-54.
Tano et al., "MALAT-1 enhances cell motility of lung adenocarcinoma cells by influencing the expression of motility-related genes" Febs Letters (2010) 584(22): 4575-4580.
Tripathi et al., "The nuclear-retained noncoding RNA MALAT1 regulates alternative splicing by modulating SR splicing factor phosphorylation" Mol. Cell (2010) 39(6):925-938.
Verbeure et al., "RNase H mediated cleavage of RNA by cyclohexene nucleic acid (CeNA)" Nucleic Acids Res. (2001) 29(24):4941-4947.
Verdel et al., "RNAi-mediated targeting of heterochromatin by the RITS complex" Science (2004) 303(5668):672-676.
Volpe et al., "Regulation of heterochromatic silencing and histone H3 lysine-9 methylation by RNAi" Science (2002) 297(5588):1833;1837.
Wahlestedt et al., "Potent and nontoxic antisense oligonucleotide containing locked nucleic acids" Proc. Natl. Acad. Sci. USA (2000) 97: 5633-5638.
Wang et al., "A straightforward stereoselective synthesis of D- and L-5-hydroxy-4-hydroxymethyl-2-cyclohexenylguanine" J. Org. Chem. (2001) 66(25):8478-8482.
Wang et al., "Cyclohexene nucleic acids (CeNA) form stable duplexes with RNA and induce RNase H activity" Nucleosides Nucleotides Nucleic Acids (2001) 20(4-7):785-788.
Wang et al., "Cyclohexene Nucleic Acids (CeNA): Serum Stable Oligonucleotides that Activate RNase H and Increase Duplex Stability with Complementary RNA" J. Am. Chem. Soc. (2000) 122(36):8595-8602.
Wang et al., "Stereocontrolled synthesis of ara-type cyclohexenyl nucleosides" J. Org. Chem. (2003) 68(11):4499-4505.
Woolf et al., "Specificity of antisense oligonucleotides in vivo" PNAS (1992) 89: 7305-7309.

(56) References Cited

OTHER PUBLICATIONS

Yao et al., "A novel orthotopic tumor model to study growth factors and oncogenes in hepatocarcinogenesis" Clin. Cancer. Res. (2003) 9(7):2719-2726.

Ying et al., "Uprgulated MALAT-1 contributes to bladder cancer cell migration by inducing epithelial-to-mesenchymal transition." Mol. Biosyst. (2012) 8(9):2289-94.

Zhang et al., "PowerBLAST: A New Network BLAST Application for Interactive or Automated Sequence Analysis and Annotation" Genome Res. (1997) 7:649-656.

Zhou et al., "Fine Tuning of Electrostatics around the Internucleotidic Phosphate through Incorporation of Modified 2',4'-Carbocyclic-LNAs and -ENAs Leads to Significant Modulation of Antisense Properties" J. Org. Chem. (2009) 74:118-134.

International Search Report and Written Opinion dated Jul. 21, 2020 for PCT Application No. PCT/US2020/020169.

\* cited by examiner

MODULATORS OF MALAT1 EXPRESSION

SEQUENCE LISTING

The present application is being filed along with a Sequence Listing in electronic format. The Sequence Listing is provided as a file entitled BIOL00359USSEQ_ST25.txt created Feb. 20, 2020 which is 596 kb in size. The information in the electronic format of the sequence listing is incorporated herein by reference in its entirety.

FIELD

The present embodiments provide methods, compounds, and compositions useful for inhibiting MALAT1 expression, which can be useful for treating, preventing, or ameliorating a cancer associated with MALAT1.

BACKGROUND

Metastasis associated lung adenocarcinoma transcript 1 (MALAT1) is a non-coding lncRNA expressed in many human cell types and is highly conserved across mammalian species. MALAT1 was initially identified from metastatic NSCLC patients and is upregulated in multiple types of cancer (Zhang X. et al., RNA Biol. 2017, Ping J et al., 2003).

Certain embodiments provided herein are directed to potent and tolerable compounds and compositions useful for inhibiting MALAT1 expression, which can be useful for treating, preventing, ameliorating, or slowing progression of cancer associated with MALAT1.

DETAILED DESCRIPTION

It is to be understood that both the foregoing general description and the following detailed description are exemplary and explanatory only and are not restrictive of the embodiments, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting.

The section headings used herein are for organizational purposes only and are not to be construed as limiting the subject matter described. All documents, or portions of documents, cited in this application, including, but not limited to, patents, patent applications, articles, books, treatises, and GenBank and NCBI reference sequence records are hereby expressly incorporated by reference for the portions of the document discussed herein, as well as in their entirety.

It is understood that the sequence set forth in each SEQ ID NO in the examples contained herein is independent of any modification to a sugar moiety, an internucleoside linkage, or a nucleobase. As such, compounds defined by a SEQ ID NO may comprise, independently, one or more modifications to a sugar moiety, an internucleoside linkage, or a nucleobase. Compounds described by ION number indicate a combination of nucleobase sequence, chemical modification, and motif.

Unless otherwise indicated, the following terms have the following meanings:

"2'-deoxynucleoside" means a nucleoside comprising 2'-H(H) furanosyl sugar moiety, as found in naturally occurring deoxyribonucleic acids (DNA). In certain embodiments, a 2'-deoxynucleoside may comprise a modified nucleobase or may comprise an RNA nucleobase (uracil).

"2'-O-methoxyethyl" (also 2'-MOE and 2'-O($CH_2$)$_2$—OCH$_3$) refers to an O-methoxy-ethyl modification at the 2' position of a furanosyl ring. A 2'-O-methoxyethyl modified sugar is a modified sugar.

"2'-MOE nucleoside" (also 2'-O-methoxyethyl nucleoside) means a nucleoside comprising a 2'-MOE modified sugar moiety.

"2'-substituted nucleoside" or "2-modified nucleoside" means a nucleoside comprising a 2'-substituted or 2'-modified sugar moiety. As used herein, "2'-substituted" or "2-modified" in reference to a sugar moiety means a sugar moiety comprising at least one 2'-substituent group other than H or OH.

"3' target site" refers to the nucleotide of a target nucleic acid which is complementary to the 3'-most nucleotide of a particular compound.

"5' target site" refers to the nucleotide of a target nucleic acid which is complementary to the 5'-most nucleotide of a particular compound.

"5-methylcytosine" means a cytosine with a methyl group attached to the 5 position.

"About" means within ±10% of a value. For example, if it is stated, "the compounds affected about 70% inhibition of MALAT1", it is implied that MALAT1 levels are inhibited within a range of 60% and 80%.

"Administration" or "administering" refers to routes of introducing a compound or composition provided herein to an individual to perform its intended function. An example of a route of administration that can be used includes, but is not limited to parenteral administration, such as subcutaneous, intravenous, or intramuscular injection or infusion.

"Administered concomitantly" or "co-administration" means administration of two or more compounds in any manner in which the pharmacological effects of both are manifest in the patient. Concomitant administration does not require that both compounds be administered in a single pharmaceutical composition, in the same dosage form, by the same route of administration, or at the same time. The effects of both compounds need not manifest themselves at the same time. The effects need only be overlapping for a period of time and need not be coextensive. Concomitant administration or co-administration encompasses administration in parallel or sequentially.

"Amelioration" refers to an improvement or lessening of at least one indicator, sign, or symptom of an associated disease, disorder, or condition. In certain embodiments, amelioration includes a delay or slowing in the progression or severity of one or more indicators of a condition or disease. The progression or severity of indicators may be determined by subjective or objective measures, which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antibody," as used in this disclosure, refers to an immunoglobulin or a fragment or a derivative thereof, and encompasses any polypeptide comprising an antigen-binding site, regardless of whether it is produced in vitro or in vivo. The term includes, but is not limited to, polyclonal, monoclonal, monospecific, polyspecific, non-specific, humanized, single-chain, chimeric, synthetic, recombinant, hybrid, mutated, and grafted antibodies. Unless otherwise modified by the term "intact," as in "intact antibodies," for the purposes of this disclosure, the term "antibody" also includes antibody fragments such as Fab, F(ab')2, Fv, scFv, Fd, dAb, and other antibody fragments that retain antigen-binding function, i.e., the ability to bind, for example, CTLA-4 or PD-L1 specifically. Typically, such fragments would comprise an antigen-binding domain.

"Anti-CTLA-4 antibody" refers to an antibody or antigen binding fragment thereof that specifically binds a CTLA-4 polypeptide. Exemplary anti-CTLA-4 antibodies are described for example at U.S. Pat. Nos. 6,682,736; 7,109,003; 7,123,281; 7,411,057; 7,824,679; 8,143,379; 7,807,797; and 8,491,895 (Tremelimumab is 11.2.1, therein), which are herein incorporated by reference. Tremelimumab (U.S. Pat. No. 6,682,736) is an exemplary anti-CTLA-4 antibody. Tremelimumab VL, VH, and CDR amino acid sequences are provided at SEQ ID NOs: 1-8, herein.

"Anti-OX40 antibody" refers to an antibody or antigen binding fragment thereof that specifically binds OX40. OX40 antibodies include monoclonal and polyclonal antibodies that are specific for OX40 and antigen-binding fragments thereof. In certain aspects, anti-OX40 antibodies as described herein are monoclonal antibodies (or antigen-binding fragments thereof), e.g., murine, humanized, or fully human monoclonal antibodies. In one particular embodiment, the OX40 antibody is an OX40 receptor agonist, such as the mouse anti-human OX40 monoclonal antibody (9B12) described by Weinberg et al., J Immunother 29, 575-585 (2006). In another embodiment, an OX40 antibody is MEDI0562 as described in US 2016/0137740, incorporated herein by reference. MEDI0562 VH and VL amino acid sequences are provided at SEQ ID NOs: 25-26, herein. In other embodiments, the antibody which specifically binds to OX40, or an antigen-binding fragment thereof, binds to the same OX40 epitope as mAb 9B12.

"Anti-PD-L1 antibody" refers to an antibody or antigen binding fragment thereof that specifically binds a PD-L1 polypeptide. Exemplary anti-PD-L1 antibodies are described for example at US2013/0034559, U.S. Pat. Nos. 8,779,108 and 9,493,565 which are herein incorporated by reference. Durvalumab (MEDI4736) is an exemplary anti-PD-L1 antibody. Durvalumab VL, VH, and CDR amino acid sequences are provided at SEQ ID NOs: 9-16, herein. Other anti-PD-L1 antibodies include BMS-936559 (Bristol-Myers Squibb) and MPDL3280A (atezolizumab) (Roche).

"Anti-PD-1 antibody" refers to an antibody or antigen binding fragment thereof that specifically binds a PD-1 polypeptide. Exemplary anti-PD-1 antibodies are described for example at U.S. Pat. Nos. 7,521,051; 8,008,449; 8,354,509; 9,073,994; 9,393,301; 9,402,899; and 9,439,962, which are herein incorporated by reference. Exemplary anti-PD-1 antibodies include, without limitation, nivolumab, pembrolizumab, pidilizumab, and AMP-514.

"Antigen-binding domain," "antigen-binding fragment," and "binding fragment" refer to a part of an antibody molecule that comprises amino acids responsible for the specific binding between the antibody and the antigen. In instances, where an antigen is large, the antigen-binding domain may only bind to a part of the antigen. A portion of the antigen molecule that is responsible for specific interactions with the antigen-binding domain is referred to as "epitope" or "antigenic determinant." An antigen-binding domain typically comprises an antibody light chain variable region (VL) and an antibody heavy chain variable region (VH), however, it does not necessarily have to comprise both. For example, a so-called Fd antibody fragment consists only of a VH domain, but still retains some antigen-binding function of the intact antibody. Binding fragments of an antibody are produced by recombinant DNA techniques, or by enzymatic or chemical cleavage of intact antibodies. Binding fragments include Fab, Fab', F(ab')2, Fv, and single-chain antibodies. An antibody other than a "bispecific" or "bifunctional" antibody is understood to have each of its binding sites identical. Digestion of antibodies with the enzyme, papain, results in two identical antigen-binding fragments, known also as "Fab" fragments, and a "Fc" fragment, having no antigen-binding activity but having the ability to crystallize. Digestion of antibodies with the enzyme, pepsin, results in the a F(ab')2 fragment in which the two arms of the antibody molecule remain linked and comprise two-antigen binding sites. The F(ab')2 fragment has the ability to crosslink antigen. "Fv" when used herein refers to the minimum fragment of an antibody that retains both antigen-recognition and antigen-binding sites. "Fab" when used herein refers to a fragment of an antibody that comprises the constant domain of the light chain and the CH1 domain of the heavy chain.

"mAb" refers to monoclonal antibody. Antibodies of the present disclosure comprise without limitation whole native antibodies, bispecific antibodies; chimeric antibodies; Fab, Fab', single chain V region fragments (scFv), fusion polypeptides, and unconventional antibodies.

"Antisense activity" means any detectable and/or measurable activity attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound to the target.

"Antisense compound" means a compound comprising an oligonucleotide and optionally one or more additional features, such as a conjugate group or terminal group. Examples of antisense compounds include single-stranded and double-stranded compounds, such as, oligonucleotides, ribozymes, siRNAs, shRNAs, ssRNAs, and occupancy-based compounds.

"Antisense inhibition" means reduction of target nucleic acid levels in the presence of an antisense compound complementary to a target nucleic acid compared to target nucleic acid levels in the absence of the antisense compound.

"Antisense mechanisms" are all those mechanisms involving hybridization of a compound with target nucleic acid, wherein the outcome or effect of the hybridization is either target degradation or target occupancy with concomitant stalling of the cellular machinery involving, for example, transcription or splicing.

"Antisense oligonucleotide" means an oligonucleotide having a nucleobase sequence that is complementary to a target nucleic acid or region or segment thereof. In certain embodiments, an antisense oligonucleotide is specifically hybridizable to a target nucleic acid or region or segment thereof.

"Bicyclic nucleoside" or "BNA" means a nucleoside comprising a bicyclic sugar moiety. "Bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

"Branching group" means a group of atoms having at least 3 positions that are capable of forming covalent linkages to at least 3 groups. In certain embodiments, a branching group provides a plurality of reactive sites for connecting tethered ligands to an oligonucleotide via a conjugate linker and/or a cleavable moiety.

"Cell-targeting moiety" means a conjugate group or portion of a conjugate group that is capable of binding to a particular cell type or particular cell types.

"cEt" or "constrained ethyl" means a bicyclic furanosyl sugar moiety comprising a bridge connecting the 4'-carbon and the 2'-carbon, wherein the bridge has the formula: 4'-CH(CH$_3$)—O-2'.

"cEt nucleoside" means a nucleoside comprising a cEt modified sugar moiety.

"Chemical modification" in a compound describes the substitutions or changes through chemical reaction, of any of the units in the compound relative to the original state of such unit. "Modified nucleoside" means a nucleoside having, independently, a modified sugar moiety and/or modified nucleobase. "Modified oligonucleotide" means an oligonucleotide comprising at least one modified internucleoside linkage, a modified sugar, and/or a modified nucleobase.

"Chemically distinct region" refers to a region of a compound that is in some way chemically different than another region of the same compound. For example, a region having 2'-O-methoxyethyl nucleotides is chemically distinct from a region having nucleotides without 2'-O-methoxyethyl modifications.

"Chimeric antisense compounds" means antisense compounds that have at least 2 chemically distinct regions, each position having a plurality of subunits.

"Chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

"Cleavable bond" means any chemical bond capable of being split. In certain embodiments, a cleavable bond is selected from among: an amide, a polyamide, an ester, an ether, one or both esters of a phosphodiester, a phosphate ester, a carbamate, a di-sulfide, or a peptide.

"Cleavable moiety" means a bond or group of atoms that is cleaved under physiological conditions, for example, inside a cell, an animal, or a human.

"Complementary" in reference to an oligonucleotide means the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to the following pairs: adenine (A) and thymine (T), adenine (A) and uracil (U), cytosine (C) and guanine (G), and 5-methyl cytosine ($^m$C) and guanine (G) unless otherwise specified. Complementary oligonucleotides and/or nucleic acids need not have nucleobase complementarity at each nucleoside and may include one or more nucleobase mismatches. By contrast, "fully complementary" or "100% complementary" in reference to oligonucleotides means that such oligonucleotides have nucleobase matches at each nucleoside without any nucleobase mismatches.

"Conjugate group" means a group of atoms that is attached to an oligonucleotide. Conjugate groups include a conjugate moiety and a conjugate linker that attaches the conjugate moiety to the oligonucleotide.

"Conjugate linker" means a group of atoms comprising at least one bond that connects a conjugate moiety to an oligonucleotide.

"Conjugate moiety" means a group of atoms that is attached to an oligonucleotide via a conjugate linker.

"Contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

"Designing" or "Designed to" refer to the process of designing a compound that specifically hybridizes with a selected nucleic acid molecule.

"Diluent" means an ingredient in a composition that lacks pharmacological activity, but is pharmaceutically necessary or desirable. For example, the diluent in an injected composition can be a liquid, e.g. saline solution.

"Differently modified" means chemical modifications or chemical substituents that are different from one another, including absence of modifications. Thus, for example, a MOE nucleoside and an unmodified DNA nucleoside are "differently modified," even though the DNA nucleoside is unmodified. Likewise, DNA and RNA are "differently modified," even though both are naturally-occurring unmodified nucleosides. Nucleosides that are the same but for comprising different nucleobases are not differently modified. For example, a nucleoside comprising a 2'-OMe modified sugar and an unmodified adenine nucleobase and a nucleoside comprising a 2'-OMe modified sugar and an unmodified thymine nucleobase are not differently modified.

"Dose" means a specified quantity of a compound or pharmaceutical agent provided in a single administration, or in a specified time period. In certain embodiments, a dose may be administered in two or more boluses, tablets, or injections. For example, in certain embodiments, where subcutaneous administration is desired, the desired dose may require a volume not easily accommodated by a single injection. In such embodiments, two or more injections may be used to achieve the desired dose. In certain embodiments, a dose may be administered in two or more injections to minimize injection site reaction in an individual. In other embodiments, the compound or pharmaceutical agent is administered by infusion over an extended period of time or continuously. Doses may be stated as the amount of pharmaceutical agent per hour, day, week or month.

"Dosing regimen" is a combination of doses designed to achieve one or more desired effects.

"Double-stranded antisense compound" means an antisense compound comprising two oligomeric compounds that are complementary to each other and form a duplex, and wherein one of the two said oligomeric compounds comprises an oligonucleotide.

"Effective amount" means the amount of compound sufficient to effectuate a desired physiological outcome in an individual in need of the compound. The effective amount may vary among individuals depending on the health and physical condition of the individual to be treated, the taxonomic group of the individuals to be treated, the formulation of the composition, assessment of the individual's medical condition, and other relevant factors.

"Efficacy" means the ability to produce a desired effect.

"Expression" includes all the functions by which a gene's coded information is converted into structures present and operating in a cell. Such structures include, but are not limited to, the products of transcription and translation.

"Gapmer" means an oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings."

"Hybridization" means the annealing of oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases. In certain embodiments, complementary nucleic acid molecules include, but are not limited to, an antisense compound and a nucleic acid target. In certain embodiments, complementary nucleic acid molecules include, but are not limited to, an oligonucleotide and a nucleic acid target.

"Immediately adjacent" means there are no intervening elements between the immediately adjacent elements of the same kind (e.g. no intervening nucleobases between the immediately adjacent nucleobases).

"Immune checkpoint inhibitor" means an agent that inhibits the expression or activity of a protein that inhibits an immune response. In one embodiment, an immune checkpoint inhibitor is an agent that inhibits the CTLA-4 or PD-1 pathways. Particular checkpoint inhibitors include antibodies that inhibit PD-1, PD-L1 or CTLA-4.

"Immunomodulatory agent" means an agent that enhances an immune response (e.g., anti-tumor immune response). Exemplary immunomodulatory agents of the present disclosure include antibodies, such as an anti-CTLA-4 antibody, an anti-PD-L1 antibody, an anti-PD-1 antibody and antigenic fragments of any of these, and OX40 agonists, including proteins, such as OX40 ligand fusion protein, OX40 antibody, or fragments thereof. In one embodiment, the immunomodulatory agent is an immune checkpoint inhibitor.

"Individual" means a human or non-human animal selected for treatment or therapy.

"Inhibiting the expression or activity" refers to a reduction or blockade of the expression or activity relative to the expression of activity in an untreated or control sample and does not necessarily indicate a total elimination of expression or activity.

"Internucleoside linkage" means a group or bond that forms a covalent linkage between adjacent nucleosides in an oligonucleotide. "Modified internucleoside linkage" means any internucleoside linkage other than a naturally occurring, phosphate internucleoside linkage. Non-phosphate linkages are referred to herein as modified internucleoside linkages.

"Lengthened oligonucleotides" are those that have one or more additional nucleosides relative to an oligonucleotide disclosed herein, e.g. a parent oligonucleotide.

"Linked nucleosides" means adjacent nucleosides linked together by an internucleoside linkage.

"Linker-nucleoside" means a nucleoside that links an oligonucleotide to a conjugate moiety. Linker-nucleosides are located within the conjugate linker of a compound. Linker-nucleosides are not considered part of the oligonucleotide portion of a compound even if they are contiguous with the oligonucleotide.

"Mismatch" or "non-complementary" means a nucleobase of a first oligonucleotide that is not complementary to the corresponding nucleobase of a second oligonucleotide or target nucleic acid when the first and second oligonucleotides are aligned. For example, nucleobases including but not limited to a universal nucleobase, inosine, and hypoxanthine, are capable of hybridizing with at least one nucleobase but are still mismatched or non-complementary with respect to nucleobase to which it hybridized. As another example, a nucleobase of a first oligonucleotide that is not capable of hybridizing to the corresponding nucleobase of a second oligonucleotide or target nucleic acid when the first and second oligonucleotides are aligned is a mismatch or non-complementary nucleobase.

"Modulating" refers to changing or adjusting a feature in a cell, tissue, organ or organism. For example, modulating MALAT1 RNA can mean to increase or decrease the level of MALAT1 RNA and/or MALAT1 protein in a cell, tissue, organ or organism. A "modulator" effects the change in the cell, tissue, organ or organism. For example, a MALAT1 compound can be a modulator that decreases the amount of MALAT1 RNA and/or MALAT1 protein in a cell, tissue, organ or organism.

"MOE" means methoxyethyl.

"Monomer" refers to a single unit of an oligomer. Monomers include, but are not limited to, nucleosides and nucleotides.

"Motif" means the pattern of unmodified and/or modified sugar moieties, nucleobases, and/or internucleoside linkages, in an oligonucleotide.

"Natural" or "naturally occurring" means found in nature.

"Non-bicyclic modified sugar" or "non-bicyclic modified sugar moiety" means a modified sugar moiety that comprises a modification, such as a substituent, that does not form a bridge between two atoms of the sugar to form a second ring.

"Nucleic acid" refers to molecules composed of monomeric nucleotides. A nucleic acid includes, but is not limited to, ribonucleic acids (RNA), deoxyribonucleic acids (DNA), single-stranded nucleic acids, and double-stranded nucleic acids.

"Nucleobase" means a heterocyclic moiety capable of pairing with a base of another nucleic acid. As used herein a "naturally occurring nucleobase" is adenine (A), thymine (T), cytosine (C), uracil (U), and guanine (G). A "modified nucleobase" is a naturally occurring nucleobase that is chemically modified. A "universal base" or "universal nucleobase" is a nucleobase other than a naturally occurring nucleobase and modified nucleobase, and is capable of pairing with any nucleobase.

"Nucleobase sequence" means the order of contiguous nucleobases in a nucleic acid or oligonucleotide independent of any sugar or internucleoside linkage.

"Nucleoside" means a compound comprising a nucleobase and a sugar moiety. The nucleobase and sugar moiety are each, independently, unmodified or modified. "Modified nucleoside" means a nucleoside comprising a modified nucleobase and/or a modified sugar moiety. Modified nucleosides include abasic nucleosides, which lack a nucleobase.

"Oligomeric compound" means a compound comprising a single oligonucleotide and optionally one or more additional features, such as a conjugate group or terminal group.

"Oligonucleotide" means a polymer of linked nucleosides each of which can be modified or unmodified, independent one from another. Unless otherwise indicated, oligonucleotides consist of 8-80 linked nucleosides. "Modified oligonucleotide" means an oligonucleotide, wherein at least one sugar, nucleobase, or internucleoside linkage is modified. "Unmodified oligonucleotide" means an oligonucleotide that does not comprise any sugar, nucleobase, or internucleoside modification.

"Parent oligonucleotide" means an oligonucleotide whose sequence is used as the basis of design for more oligonucleotides of similar sequence but with different lengths, motifs, and/or chemistries. The newly designed oligonucleotides may have the same or overlapping sequence as the parent oligonucleotide.

"Parenteral administration" means administration through injection or infusion. Parenteral administration includes subcutaneous administration, intravenous administration, intramuscular administration, intraarterial administration, intraperitoneal administration, or intracranial administration, e.g. intrathecal or intracerebroventricular administration.

"Pharmaceutically acceptable carrier or diluent" means any substance suitable for use in administering to an individual. For example, a pharmaceutically acceptable carrier can be a sterile aqueous solution, such as PBS or water-for-injection.

"Pharmaceutically acceptable salts" means physiologically and pharmaceutically acceptable salts of compounds, such as oligomeric compounds or oligonucleotides, i.e., salts that retain the desired biological activity of the parent compound and do not impart undesired toxicological effects thereto.

"Pharmaceutical agent" means a compound that provides a therapeutic benefit when administered to an individual.

"Pharmaceutical composition" means a mixture of substances suitable for administering to an individual. For example, a pharmaceutical composition may comprise one or more compounds or salt thereof and a sterile aqueous solution.

"Phosphorothioate linkage" means a modified phosphate linkage in which one of the non-bridging oxygen atoms is replaced with a sulfur atom. A phosphorothioate internucleoside linkage is a modified internucleoside linkage.

"Phosphorus moiety" means a group of atoms comprising a phosphorus atom. In certain embodiments, a phosphorus moiety comprises a mono-, di-, or tri-phosphate, or phosphorothioate.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an oligomeric compound.

"Prevent" refers to delaying or forestalling the onset, development or progression of a disease, disorder, or condition for a period of time from minutes to indefinitely.

"Prodrug" means a compound in a form outside the body which, when administered to an individual, is metabolized to another form within the body or cells thereof. In certain embodiments, the metabolized form is the active, or more active, form of the compound (e.g., drug). Typically conversion of a prodrug within the body is facilitated by the action of an enzyme(s) (e.g., endogenous or viral enzyme) or chemical(s) present in cells or tissues, and/or by physiologic conditions.

"Reduce" means to bring down to a smaller extent, size, amount, or number.

"RefSeq No." is a unique combination of letters and numbers assigned to a sequence to indicate the sequence is for a particular target transcript (e.g., target gene). Such sequence and information about the target gene (collectively, the gene record) can be found in a genetic sequence database. Genetic sequence databases include the NCBI Reference Sequence database, GenBank, the European Nucleotide Archive, and the DNA Data Bank of Japan (the latter three forming the International Nucleotide Sequence Database Collaboration or INSDC).

"Region" is defined as a portion of the target nucleic acid having at least one identifiable structure, function, or characteristic.

"RNAi compound" means an antisense compound that acts, at least in part, through RISC or Ago2, but not through RNase H, to modulate a target nucleic acid and/or protein encoded by a target nucleic acid. RNAi compounds include, but are not limited to double-stranded siRNA, single-stranded RNA (ssRNA), and microRNA, including microRNA mimics.

"Segments" are defined as smaller or sub-portions of regions within a nucleic acid.

"Side effects" means physiological disease and/or conditions attributable to a treatment other than the desired effects. In certain embodiments, side effects include injection site reactions, liver function test abnormalities, renal function abnormalities, liver toxicity, renal toxicity, central nervous system abnormalities, myopathies, and malaise. For example, increased aminotransferase levels in serum may indicate liver toxicity or liver function abnormality. For example, increased bilirubin may indicate liver toxicity or liver function abnormality.

"Single-stranded" in reference to a compound means the compound has only one oligonucleotide. "Self-complementary" means an oligonucleotide that at least partially hybridizes to itself. A compound consisting of one oligonucleotide, wherein the oligonucleotide of the compound is self-complementary, is a single-stranded compound. A single-stranded compound may be capable of binding to a complementary compound to form a duplex.

"Sites" are defined as unique nucleobase positions within a target nucleic acid.

"Specifically hybridizable" refers to an oligonucleotide having a sufficient degree of complementarity between the oligonucleotide and a target nucleic acid to induce a desired effect, while exhibiting minimal or no effects on non-target nucleic acids. In certain embodiments, specific hybridization occurs under physiological conditions.

"Specifically inhibit" with reference to a target nucleic acid means to reduce or block expression of the target nucleic acid while exhibiting fewer, minimal, or no effects on non-target nucleic acids. Reduction does not necessarily indicate a total elimination of the target nucleic acid's expression.

"Standard cell assay" means assay(s) described in the Examples and reasonable variations thereof "Standard in vivo experiment" means the procedure(s) described in the Example(s) and reasonable variations thereof.

"Stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

"Sugar moiety" means an unmodified sugar moiety or a modified sugar moiety. "Unmodified sugar moiety" or "unmodified sugar" means a 2'-OH(H) furanosyl moiety, as found in RNA (an "unmodified RNA sugar moiety"), or a 2'-H(H) moiety, as found in DNA (an "unmodified DNA sugar moiety"). Unmodified sugar moieties have one hydrogen at each of the 1', 3', and 4' positions, an oxygen at the 3' position, and two hydrogens at the 5' position. "Modified sugar moiety" or "modified sugar" means a modified furanosyl sugar moiety or a sugar surrogate. "Modified furanosyl sugar moiety" means a furanosyl sugar comprising a non-hydrogen substituent in place of at least one hydrogen of an unmodified sugar moiety. In certain embodiments, a modified furanosyl sugar moiety is a 2'-substituted sugar moiety. Such modified furanosyl sugar moieties include bicyclic sugars and non-bicyclic sugars.

"Sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary compounds or nucleic acids.

"Synergy" or "synergize" refers to an effect of a combination that is greater than additive of the effects of each component alone at the same doses.

"MALAT1" means any nucleic acid or protein of MALAT1. "MALAT1 nucleic acid" means any nucleic acid encoding MALAT1. For example, in certain embodiments, a MALAT1 nucleic acid includes a DNA sequence encoding MALAT1, an RNA sequence transcribed from DNA encoding MALAT1 (including genomic DNA comprising introns and exons), and an mRNA sequence encoding MALAT1. "MALAT1 mRNA" means an mRNA encoding a MALAT1 protein. The target may be referred to in either upper or lower case.

"MALAT1 specific inhibitor" refers to any agent capable of specifically inhibiting MALAT1 RNA and/or MALAT1 protein expression or activity at the molecular level. For example, MALAT1 specific inhibitors include nucleic acids (including antisense compounds), peptides, antibodies, small molecules, and other agents capable of inhibiting the expression of MALAT1 RNA and/or MALAT1 protein.

"Target gene" refers to a gene encoding a target.

"Targeting" means the specific hybridization of a compound to a target nucleic acid in order to induce a desired effect.

"Target nucleic acid," "target RNA," "target RNA transcript" and "nucleic acid target" all mean a nucleic acid capable of being targeted by compounds described herein.

"Target region" means a portion of a target nucleic acid to which one or more compounds is targeted.

"Target segment" means the sequence of nucleotides of a target nucleic acid to which a compound is targeted. "5' target site" refers to the 5'-most nucleotide of a target segment. "3' target site" refers to the 3'-most nucleotide of a target segment.

"Terminal group" means a chemical group or group of atoms that is covalently linked to a terminus of an oligonucleotide.

"Therapeutically effective amount" means an amount of a compound, pharmaceutical agent, or composition that provides a therapeutic benefit to an individual.

"Treat" refers to administering a compound or pharmaceutical composition to an animal in order to effect an alteration or improvement of a disease, disorder, or condition in the animal.

CERTAIN EMBODIMENTS

Certain embodiments provide methods, compounds and compositions for inhibiting MALAT1 expression.

Certain embodiments provide compounds targeted to a MALAT1 nucleic acid. In certain embodiments, the MALAT1 nucleic acid has the sequence set forth in RefSeq or GENBANK Accession No. XR_001309.1 (SEQ ID NO: 1) (which is incorporated by reference in its entirety), or GENBANK Accession No. EF177381.1 (SEQ ID NO: 2824) (which is incorporated by reference in its entirety). In certain embodiments, the compound is an antisense compound or oligomeric compound. In certain embodiments, the compound is single-stranded. In certain embodiments, the compound is double-stranded.

Certain embodiments provide a compound comprising a modified oligonucleotide consisting of 8 to 80 linked nucleosides and having a nucleobase sequence comprising at least 8 contiguous nucleobases of any of the nucleobase sequences of SEQ ID NOs: 2-10 or 36-2813. In certain embodiments, the compound is an antisense compound or oligomeric compound. In certain embodiments, the compound is single-stranded. In certain embodiments, the compound is double-stranded. In certain embodiments, the modified oligonucleotide consists of 10 to 30 linked nucleosides.

Certain embodiments provide a compound comprising a modified oligonucleotide consisting of 8 to 80 linked nucleosides and having a nucleobase sequence comprising at least 8 contiguous nucleobases of any of the nucleobase sequences of SEQ ID NOs: 2-10. In certain embodiments, the compound is an antisense compound or oligomeric compound. In certain embodiments, the compound is single-stranded. In certain embodiments, the compound is double-stranded. In certain embodiments, the modified oligonucleotide consists of 10 to 30 linked nucleosides.

Certain embodiments provide a compound comprising a modified oligonucleotide consisting of 9 to 80 linked nucleosides and having a nucleobase sequence comprising at least 9 contiguous nucleobases of any of the nucleobase sequences of SEQ ID NOs: 2-10 or 36-2813. In certain embodiments, the compound is an antisense compound or oligomeric compound. In certain embodiments, the compound is single-stranded. In certain embodiments, the compound is double-stranded. In certain embodiments, the modified oligonucleotide consists of 10 to 30 linked nucleosides.

Certain embodiments provide a compound comprising a modified oligonucleotide consisting of 9 to 80 linked nucleosides and having a nucleobase sequence comprising at least 9 contiguous nucleobases of any of the nucleobase sequences of SEQ ID NOs: 2-10. In certain embodiments, the compound is an antisense compound or oligomeric compound. In certain embodiments, the compound is single-stranded. In certain embodiments, the compound is double-stranded. In certain embodiments, the modified oligonucleotide consists of 10 to 30 linked nucleosides.

Certain embodiments provide a compound comprising a modified oligonucleotide consisting of 10 to 80 linked nucleosides and having a nucleobase sequence comprising at least 10 contiguous nucleobases of any of the nucleobase sequences of SEQ ID NOs: 2-10 or 36-2813. In certain embodiments, the compound is an antisense compound or oligomeric compound. In certain embodiments, the compound is single-stranded. In certain embodiments, the compound is double-stranded. In certain embodiments, the modified oligonucleotide consists of 10 to 30 linked nucleosides.

Certain embodiments provide a compound comprising a modified oligonucleotide consisting of 10 to 80 linked nucleosides and having a nucleobase sequence comprising at least 10 contiguous nucleobases of any of the nucleobase sequences of SEQ ID NOs: 2-10. In certain embodiments, the compound is an antisense compound or oligomeric compound. In certain embodiments, the compound is single-stranded. In certain embodiments, the compound is double-stranded. In certain embodiments, the modified oligonucleotide consists of 10 to 30 linked nucleosides.

Certain embodiments provide a compound comprising a modified oligonucleotide consisting of 11 to 80 linked nucleosides and having a nucleobase sequence comprising at least 11 contiguous nucleobases of any of the nucleobase sequences of SEQ ID NOs: 2-10 or 36-2813. In certain embodiments, the compound is an antisense compound or oligomeric compound. In certain embodiments, the compound is single-stranded. In certain embodiments, the compound is double-stranded. In certain embodiments, the modified oligonucleotide consists of 11 to 30 linked nucleosides.

Certain embodiments provide a compound comprising a modified oligonucleotide consisting of 11 to 80 linked nucleosides and having a nucleobase sequence comprising at least 11 contiguous nucleobases of any of the nucleobase sequences of SEQ ID NOs: 2-10. In certain embodiments, the compound is an antisense compound or oligomeric compound. In certain embodiments, the compound is single-stranded. In certain embodiments, the compound is double-stranded. In certain embodiments, the modified oligonucleotide consists of 11 to 30 linked nucleosides.

Certain embodiments provide a compound comprising a modified oligonucleotide consisting of 12 to 80 linked nucleosides and having a nucleobase sequence comprising at least 12 contiguous nucleobases of any of the nucleobase sequences of SEQ ID NOs: 2-10 or 36-2813. In certain embodiments, the compound is an antisense compound or oligomeric compound. In certain embodiments, the compound is single-stranded. In certain embodiments, the compound is double-stranded. In certain embodiments, the modified oligonucleotide consists of 12 to 30 linked nucleosides.

Certain embodiments provide a compound comprising a modified oligonucleotide consisting of 12 to 80 linked nucleosides and having a nucleobase sequence comprising at least 12 contiguous nucleobases of any of the nucleobase sequences of SEQ ID NOs: 2-10. In certain embodiments, the compound is an antisense compound or oligomeric compound. In certain embodiments, the compound is single-stranded. In certain embodiments, the compound is double-stranded. In certain embodiments, the modified oligonucleotide consists of 12 to 30 linked nucleosides.

Certain embodiments provide a compound comprising a modified oligonucleotide consisting of 16 to 80 linked nucleosides and having a nucleobase sequence comprising the nucleobase sequence of any one of SEQ ID NOs: 2-10 or 36-2813. In certain embodiments, the compound is an antisense compound or oligomeric compound. In certain embodiments, the compound is single-stranded. In certain embodiments, the compound is double-stranded. In certain embodiments, the modified oligonucleotide consists of 16 to 30 linked nucleosides.

Certain embodiments provide a compound comprising a modified oligonucleotide consisting of 16 to 80 linked nucleosides and having a nucleobase sequence comprising the nucleobase sequence of any one of SEQ ID NOs: 2-10. In certain embodiments, the compound is an antisense compound or oligomeric compound. In certain embodiments, the compound is single-stranded. In certain embodiments, the compound is double-stranded. In certain embodiments, the modified oligonucleotide consists of 16 to 30 linked nucleosides.

Certain embodiments provide a compound comprising a modified oligonucleotide having a nucleobase sequence consisting of the nucleobase sequence of any one of SEQ ID NOs: 2-10 or 36-2813. In certain embodiments, the compound is an antisense compound or oligomeric compound. In certain embodiments, the compound is single-stranded. In certain embodiments, the compound is double-stranded.

Certain embodiments provide a compound comprising a modified oligonucleotide having a nucleobase sequence consisting of the nucleobase sequence of any one of SEQ ID NOs: 2-10. In certain embodiments, the compound is an antisense compound or oligomeric compound. In certain embodiments, the compound is single-stranded. In certain embodiments, the compound is double-stranded.

In certain embodiments, a compound comprises a modified oligonucleotide consisting of 8 to 80 linked nucleosides wherein the nucleobase sequence of the modified oligonucleotide comprises an at least 8, 9, 10, 11, 12, 13, 14, 15, or 16 contiguous nucleobase portion complementary to an equal length portion within nucleotides 1535-1550, 2034-2049, 2341-2356, 4821-4836, 4840-4855, 4931-4946, 5049-5064, 5494-5509, or 5495-5510 of SEQ ID NO: 1. In certain embodiments, the modified oligonucleotide consists of 10 to 30 linked nucleosides. In certain embodiments, the modified oligonucleotide consists of 16 to 30 linked nucleosides.

In certain embodiments, a compound comprises a modified oligonucleotide consisting of 8 to 80 linked nucleosides wherein the nucleobase sequence of the modified oligonucleotide is complementary within nucleotides 1535-1550, 2034-2049, 2341-2356, 4821-4836, 4840-4855, 4931-4946, 5049-5064, 5494-5509, or 5495-5510 of SEQ ID NO: 1. In certain embodiments, the modified oligonucleotide consists of 10 to 30 linked nucleosides. In certain embodiments, the modified oligonucleotide consists of 16 to 30 linked nucleosides.

In certain embodiments, a compound comprises a modified oligonucleotide consisting of 8 to 80 linked nucleosides and having a nucleobase sequence comprising at least an 8, 9, 10, 11, 12, 13, 14, 15, or 16 contiguous nucleobase portion of the nucleobase sequence of any one of SEQ ID NOs: 2-10 or 36-2813. In certain embodiments, the modified oligonucleotide consists of 10 to 30 linked nucleosides. In certain embodiments, the modified oligonucleotide consists of 16 to 30 linked nucleosides.

In certain embodiments, a compound comprises a modified oligonucleotide consisting of 8 to 80 linked nucleosides and having a nucleobase sequence comprising at least an 8, 9, 10, 11, 12, 13, 14, 15, or 16 contiguous nucleobase portion of the nucleobase sequence of any one of SEQ ID NOs: 2-10. In certain embodiments, the modified oligonucleotide consists of 10 to 30 linked nucleosides. In certain embodiments, the modified oligonucleotide consists of 16 to 30 linked nucleosides.

In certain embodiments, a compound comprises a modified oligonucleotide consisting of 16 to 80 linked nucleosides and having a nucleobase sequence comprising the nucleobase sequence of any one of SEQ ID NOs: 2-10 or 36-2813. In certain embodiments, the modified oligonucleotide consists of 16 to 30 linked nucleosides.

In certain embodiments, a compound comprises a modified oligonucleotide consisting of 16 to 80 linked nucleosides and having a nucleobase sequence comprising the nucleobase sequence of any one of SEQ ID NOs: 2-10. In certain embodiments, the modified oligonucleotide consists of 16 to 30 linked nucleosides.

In certain embodiments, a compound comprises a modified oligonucleotide consisting of 16 linked nucleosides and having a nucleobase sequence consisting of the nucleobase sequence of any one of SEQ ID NOs: 2-10 or 36-2813.

In certain embodiments, a compound comprises a modified oligonucleotide consisting of 16 linked nucleosides and having a nucleobase sequence consisting of the nucleobase sequence of any one of SEQ ID NOs: 2-10.

In certain embodiments, at least one internucleoside linkage of any of the foregoing modified oligonucleotides is a modified internucleoside linkage, at least one sugar of any of the foregoing modified oligonucleotides is a modified sugar, and/or at least one nucleobase of any of the foregoing modified oligonucleotides is a modified nucleobase.

In certain embodiments, at least one nucleoside of any of the foregoing modified oligonucleotides comprises a modified sugar. In certain embodiments, the modified sugar comprises a 2'-O-methoxyethyl group. In certain embodiments, the modified sugar is a bicyclic sugar, such as a 4'-CH(CH$_3$)—O-2' group, a 4'-CH$_2$—O-2' group, or a 4'-(CH$_2$)$_2$—O-2' group.

In certain embodiments, at least one internucleoside linkage of the modified oligonucleotide is a modified internucleoside linkage, such as a phosphorothioate internucleoside linkage.

In certain embodiments, at least one nucleobase of any of the foregoing modified oligonucleotides is a modified nucleobase, such as 5-methylcytosine.

In certain embodiments, any of the foregoing modified oligonucleotides has:
a gap segment consisting of linked 2'-deoxynucleosides;
a 5' wing segment consisting of linked nucleosides; and
a 3' wing segment consisting of linked nucleosides;
wherein the gap segment is positioned between the 5' wing segment and the 3' wing segment and wherein each nucleoside of each wing segment comprises a modified sugar. In certain embodiments, the modified oligonucleotide consists of 16 to 80 linked nucleosides and has a nucleobase sequence comprising the nucleobase sequence recited in any one of SEQ ID NOs: 2-10 or 36-2813. In certain embodiments, the modified oligonucleotide consists of 16 to 80 linked nucleosides and has a nucleobase sequence comprising the nucleobase sequence recited in any one of SEQ ID NOs: 2-10. In certain embodiments, the modified oligonucleotide consists of 16 to 30 linked nucleosides and has a nucleobase sequence comprising the nucleobase sequence recited in any one of SEQ ID NOs: 2-10 or 36-2813. In certain embodiments, the modified oligonucleotide consists of 16 to 30 linked nucleosides and has a nucleobase sequence comprising the nucleobase sequence recited in any one of SEQ ID NOs: 2-10. In certain embodiments, the modified oligonucleotide consists of 16 linked nucleosides and has a nucleobase sequence consisting of the nucleobase sequence recited in any one of SEQ ID NOs: 2-10 or 36-2813. In certain embodiments, the modified oligonucleotide consists of 16 linked nucleosides and has a nucleobase sequence consisting of the nucleobase sequence recited in any one of SEQ ID NOs: 2-10.

In certain embodiments, a compound comprises or consists of a modified oligonucleotide consisting of 16 to 80 linked nucleobases and having a nucleobase sequence comprising the nucleobase sequence recited in any one of SEQ ID NOs: 2-10 or 36-2813, wherein the modified oligonucleotide has:
a gap segment consisting of linked 2'-deoxynucleosides;
a 5' wing segment consisting of linked nucleosides; and
a 3' wing segment consisting of linked nucleosides;
wherein the gap segment is positioned between the 5' wing segment and the 3' wing segment and wherein each nucleoside of each wing segment comprises a modified sugar. In certain embodiments, the modified oligonucleotide consists of 16 to 30 linked nucleosides. In certain embodiments, the modified oligonucleotide consists of 16 linked nucleosides.

In certain embodiments, a compound comprises or consists of a modified oligonucleotide consisting of 16 to 80 linked nucleobases and having a nucleobase sequence comprising the nucleobase sequence recited in any one of SEQ ID NOs: 2-10, wherein the modified oligonucleotide has:
a gap segment consisting of linked 2'-deoxynucleosides;
a 5' wing segment consisting of linked nucleosides; and
a 3' wing segment consisting of linked nucleosides;
wherein the gap segment is positioned between the 5' wing segment and the 3' wing segment and wherein each nucleoside of each wing segment comprises a modified sugar. In certain embodiments, the modified oligonucleotide consists of 16 to 30 linked nucleosides. In certain embodiments, the modified oligonucleotide consists of 16 linked nucleosides.

In certain embodiments, a compound comprises or consists of a modified oligonucleotide consisting of 16 to 80 linked nucleobases and having a nucleobase sequence comprising the nucleobase sequence recited in any one of SEQ ID NOs: 36-2646 or 2664-2813, wherein the modified oligonucleotide has:

a gap segment consisting of ten linked 2'-deoxynucleosides;
a 5' wing segment consisting of three linked nucleosides; and
a 3' wing segment consisting of three linked nucleosides;
wherein the gap segment is positioned between the 5' wing segment and the 3' wing segment; wherein each nucleoside of each wing segment comprises a cEt nucleoside; wherein each internucleoside linkage is a phosphorothioate linkage; and wherein each cytosine is 5-methylcytosine. In certain embodiments, the modified oligonucleotide consists of 16 to 30 linked nucleosides. In certain embodiments, the modified oligonucleotide consists of 16 linked nucleosides.

In certain embodiments, a compound comprises or consists of a modified oligonucleotide consisting of 16 to 80 linked nucleobases and having a nucleobase sequence comprising the nucleobase sequence recited in any one of SEQ ID NOs: 2-7, wherein the modified oligonucleotide has:

a gap segment consisting of ten linked 2'-deoxynucleosides;
a 5' wing segment consisting of three linked nucleosides; and
a 3' wing segment consisting of three linked nucleosides;
wherein the gap segment is positioned between the 5' wing segment and the 3' wing segment; wherein each nucleoside of each wing segment comprises a cEt nucleoside; wherein each internucleoside linkage is a phosphorothioate linkage; and wherein each cytosine is 5-methylcytosine. In certain embodiments, the modified oligonucleotide consists of 16 to 30 linked nucleosides. In certain embodiments, the modified oligonucleotide consists of 16 linked nucleosides.

In certain embodiments, a compound comprises or consists of a modified oligonucleotide having a nucleobase sequence comprising the nucleobase sequence recited in any of SEQ ID NOs: 8-10; wherein the modified oligonucleotide comprises the sugar motif kkk-d-y-d(8)-kkk, wherein "k" indicates a cEt modified sugar moiety, "d" indicates an unmodified 2'-deoxyribosyl sugar moiety, and "y" indicates a 2'-O-methyl modified sugar moiety; wherein each internucleoside linkage is a phosphorothioate linkage; and wherein each cytosine is 5-methylcytosine. In certain embodiments, the modified oligonucleotide consisting of 16 to 30 linked nucleosides. In certain embodiments, the modified oligonucleotide consists of 16 linked nucleosides.

In certain embodiments, a compound comprises or consists of ION 1304884 having the nucleobase sequence and chemical motif: GksGksAksTdsUysAdsAdsTdsGdsTdsAdsGdsTdsGksTksAk (SEQ ID NO: 8), wherein "d" represents a 2'-deoxyribose sugar, "k" represents a cEt modified sugar, "y" represents a 2'-O-methyl modified sugar, "s" represents a phosphorothioate internucleoside linkage, and "mC" refers to 5-methylcytosine. In certain embodiments, the modified oligonucleotide consists of 16 to 30 linked nucleosides. In certain embodiments, the modified oligonucleotide consists of 16 linked nucleosides.

In certain embodiments, a compound comprises or consists of ION 1304890 having the nucleobase sequence and chemical motif: GksGksTksTdsAysTdsAdsGdsmCdsTdsTdsGdsAdsmCksAksAk (SEQ ID NO: 9), wherein "d" represents a 2'-deoxyribose sugar, "k" represents a cEt modified sugar, "y" represents a 2'-O-methyl modified sugar, "s" represents a phosphorothioate internucleoside linkage, and "mC" refers to a 5-methylcytosine. In certain embodiments, the modified oligonucleotide consists of 16 to 30 linked nucleosides. In certain embodiments, the modified oligonucleotide consists of 16 linked nucleosides.

In certain embodiments, a compound comprises or consists of ION 1304906 having the nucleobase sequence and chemical motif: GksmCksAksGdsAysTdsAdsAdsTdsGdsTdsTdsmCdsTksmCksAk (SEQ ID NO: 10), wherein "d" represents a 2'-deoxyribose sugar, "k" represents a cEt modified sugar, "y" represents a 2'-O-methyl modified sugar, "s" represents a phosphorothioate internucleoside linkage, and "mC" refers to 5-methylcytosine. In certain embodiments, the modified oligonucleotide consists of 16 to 30 linked nucleosides. In certain embodiments, the modified oligonucleotide consists of 16 linked nucleosides.

Certain embodiments provide a modified oligonucleotide according to the following chemical structure:

(SEQ ID NO: 6)

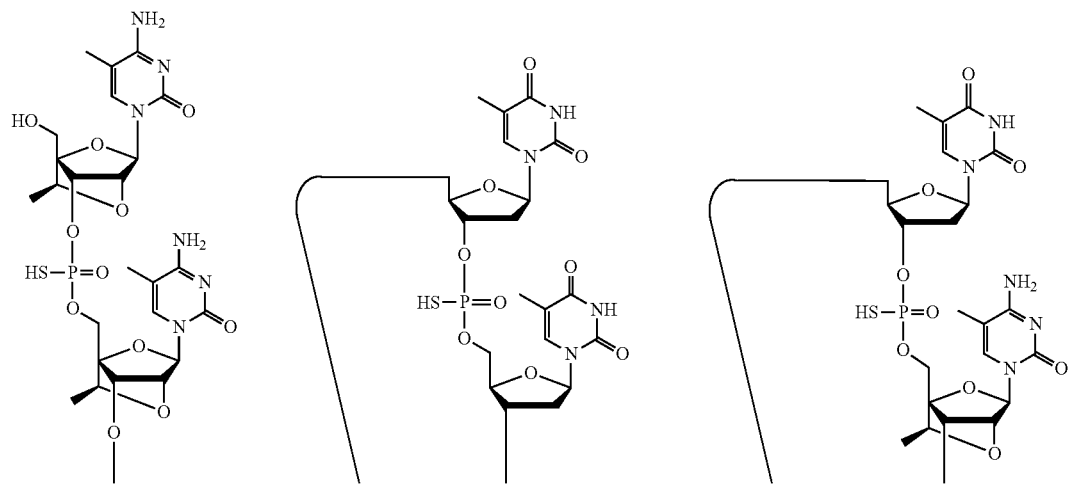

-continued
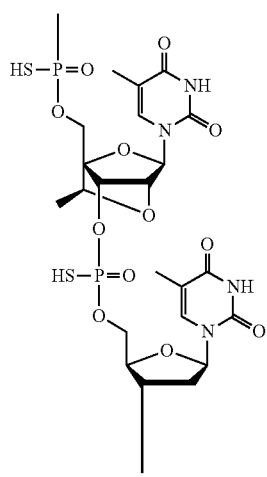
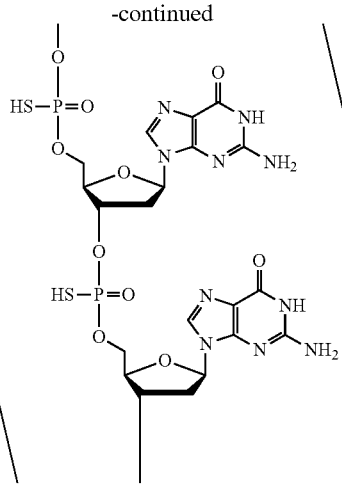
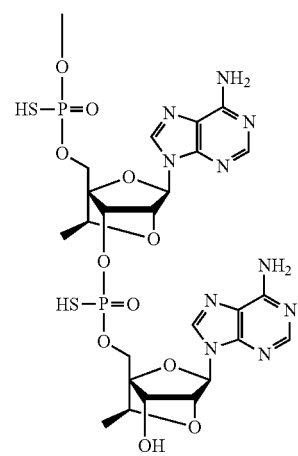
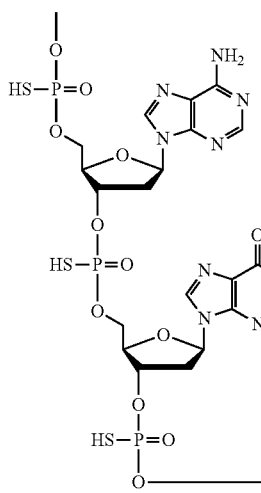
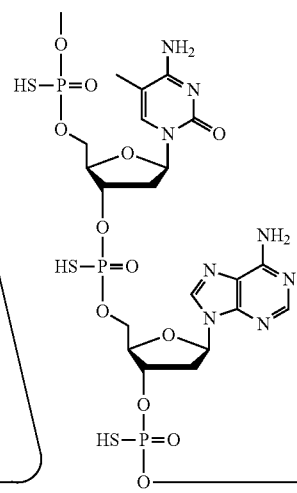
or a salt thereof. In certain embodiments, the modified oligonucleotide is the sodium salt or potassium salt.
Certain embodiments provide a modified oligonucleotide according to the following chemical structure:
(SEQ ID NO: 6)
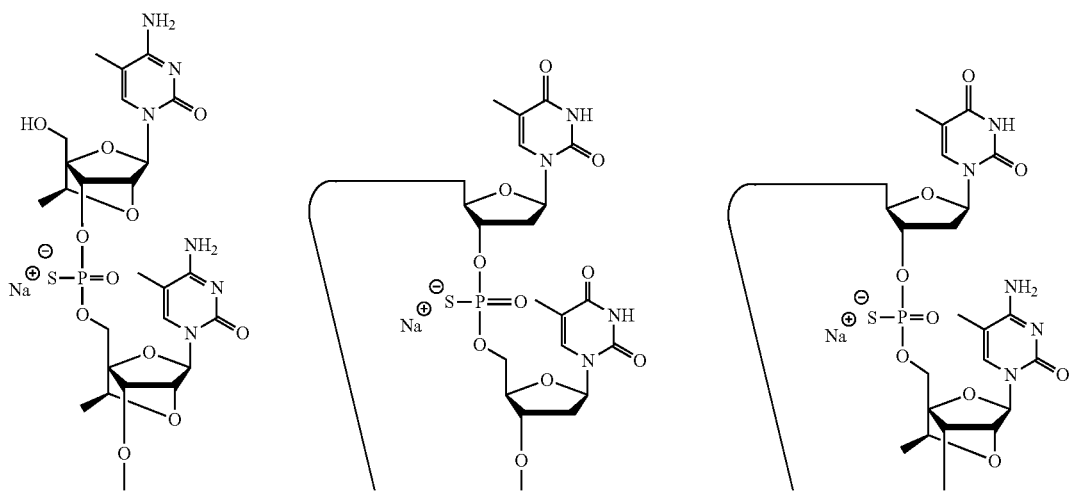

-continued

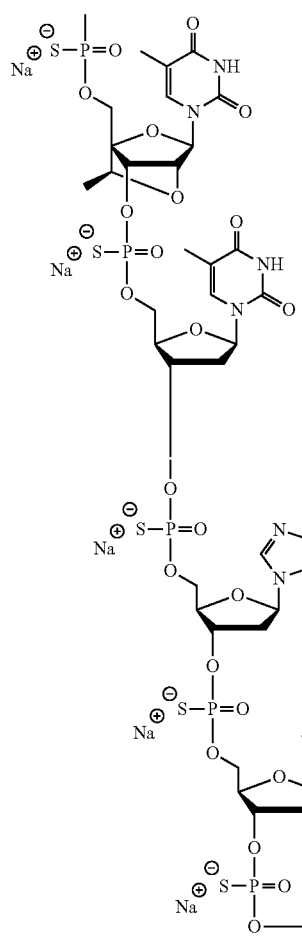
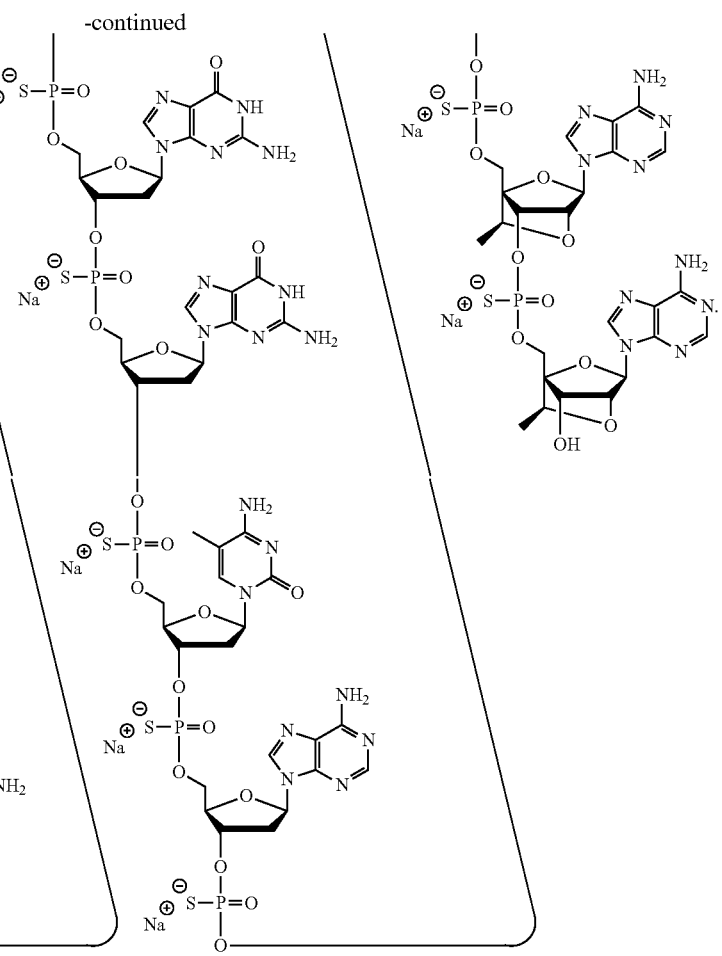

Under certain conditions, certain compounds disclosed herein act as acids. Although such compounds may be drawn or described in protonated (free acid) form, or ionized and in association with a cation (salt) form, aqueous solutions of such compounds exist in equilibrium among such forms. For example, a phosphate linkage of an oligonucleotide in aqueous solution exists in equilibrium among free acid, anion and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. Unless otherwise indicated, an oligonucleotide described herein and the term "oligonucleotide" are intended to include all such forms. Drawn structures necessarily depict a single form. Nevertheless, unless otherwise indicated, such drawings are likewise intended to include corresponding forms. Herein, a structure depicting the free acid of a compound followed by the term "or a salt thereof" expressly includes all such forms that may be fully or partially protonated/de-protonated/in association with a cation. In certain instances, one or more specific cation is identified.

In any of the foregoing embodiments, the compound or oligonucleotide can be at least 85%, at least 90%, at least 95%, at least 98%, at least 99%, or 100% complementary to a nucleic acid encoding MALAT1.

In any of the foregoing embodiments, the compound can be single-stranded. In certain embodiments, the compound comprises deoxyribonucleotides. In certain embodiments, the compound is double-stranded. In certain embodiments, the compound is double-stranded and comprises ribonucleotides. In any of the foregoing embodiments, the compound can be an antisense compound or oligomeric compound.

In any of the foregoing embodiments, the compound can consisting of 8 to 80, 10 to 30, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked nucleosides. In certain embodiments, the compound comprises or consists of an oligonucleotide.

In certain embodiments, compounds or compositions provided herein comprise a salt of the modified oligonucleotide. In certain embodiments, the salt is a sodium salt. In certain embodiments, the salt is a potassium salt.

In certain embodiments, the compounds or compositions as described herein are highly tolerable as demonstrated by having at least one of an increase an alanine transaminase (ALT) or aspartate transaminase (AST) value of no more than 4 fold, 3 fold, or 2 fold over saline treated animals or an increase in liver, spleen, or kidney weight of no more than 30%, 20%, 15%, 12%, 10%, 5%, or 2% compared to control treated animals. In certain embodiments, the compounds or compositions as described herein are highly tolerable as demonstrated by having no increase of ALT or AST over control treated animals. In certain embodiments, the compounds or compositions as described herein are highly tolerable as demonstrated by having no increase in liver, spleen, or kidney weight over control animals.

Certain embodiments provide a composition comprising the compound of any of the aforementioned embodiments or salt thereof and at least one of a pharmaceutically acceptable carrier or diluent. In certain embodiments, the composition has a viscosity less than about 40 centipoise (cP), less than about 30 centipose (cP), less than about 20 centipoise (cP), less than about 15 centipose (cP), or less than about 10 centipose (cP). In certain embodiments, the composition having any of the aforementioned viscosities comprises a compound provided herein at a concentration of about 100 mg/mL, about 125 mg/mL, about 150 mg/mL, about 175 mg/mL, about 200 mg/mL, about 225 mg/mL, about 250 mg/mL, about 275 mg/mL, or about 300 mg/mL. In certain embodiments, the composition having any of the aforementioned viscosities and/or compound concentrations has a temperature of room temperature or about 20° C., about 21° C., about 22° C., about 23° C., about 24° C., about 25° C., about 26° C., about 27° C., about 28° C., about 29° C., or about 30° C.

Non-limiting numbered embodiments include:

E1. A compound comprising a modified oligonucleotide 8 to 80 linked nucleosides in length and having a nucleobase sequence comprising at least 8 contiguous nucleobases of any of the nucleobase sequences of SEQ ID NOs: 2-10.

E2. A compound comprising a modified oligonucleotide 9 to 80 linked nucleosides in length and having a nucleobase sequence comprising at least 9 contiguous nucleobases of any of the nucleobase sequences of SEQ ID NOs: 2-10.

E3. A compound comprising a modified oligonucleotide 10 to 80 linked nucleosides in length and having a nucleobase sequence comprising at least 10 contiguous nucleobases of any of the nucleobase sequences of SEQ ID NOs: 2-10.

E4. A compound comprising a modified oligonucleotide 11 to 80 linked nucleosides in length and having a nucleobase sequence comprising at least 11 contiguous nucleobases of any of the nucleobase sequences of SEQ ID NOs: 2-10.

E5. A compound comprising a modified oligonucleotide 12 to 80 linked nucleosides in length and having a nucleobase sequence comprising at least 12 contiguous nucleobases of any of the nucleobase sequences of SEQ ID NOs: 2-10.

E6. A compound comprising a modified oligonucleotide 16 to 80 linked nucleosides in length and having a nucleobase sequence comprising the nucleobase sequence of any one of SEQ ID NOs: 2-10.

E7. A compound comprising a modified oligonucleotide 16 linked nucleosides in length and having a nucleobase sequence consisting of any one of SEQ ID NOs: 2-10.

E8. A compound comprising a modified oligonucleotide 8 to 80 linked nucleosides in length and complementary within nucleotides 1535-1550, 2034-2049, 2341-2356, 4821-4836, 4840-4855, 4931-4946, 5049-5064, 5494-5509, or 5495-5510 of SEQ ID NO: 1.

E9. The compound of any one of embodiments E1-E8, wherein the modified oligonucleotide comprises at least one modified internucleoside linkage, at least one modified sugar, or at least one modified nucleobase.

E10. The compound of embodiment E9, wherein the modified internucleoside linkage is a phosphorothioate internucleoside linkage.

E11. The compound of embodiments E9 or E10, wherein the modified sugar is a bicyclic sugar.

E12. The compound of embodiment E11, wherein the bicyclic sugar is selected from the group consisting of: 4'-(CH$_2$)—O-2' (LNA); 4'-(CH$_2$)$_2$—O-2' (ENA); and 4'-CH (CH$_3$)—O-2' (cEt).

E13. The compound of embodiments E9 or E10, wherein the modified sugar is 2'-O-methoxyethyl.

E14. The compound of any one of embodiments E9-E13, wherein the modified nucleobase is a 5-methylcytosine.

E15. The compound of any one of embodiments E1-E14, wherein the modified oligonucleotide comprises:
a gap segment consisting of linked 2'-deoxynucleosides;
a 5' wing segment consisting of linked nucleosides; and
a 3' wing segment consisting of linked nucleosides;
wherein the gap segment is positioned between the 5' wing segment and the 3' wing segment and wherein each nucleoside of each wing segment comprises a modified sugar.

E16. A compound comprising a modified oligonucleotide 16 to 80 linked nucleosides in length and having a nucleobase sequence comprising any one of SEQ ID NOs: 2-10, wherein the modified oligonucleotide comprises:
a gap segment consisting of linked 2'-deoxynucleosides;
a 5' wing segment consisting of linked nucleosides; and
a 3' wing segment consisting of linked nucleosides;
wherein the gap segment is positioned between the 5' wing segment and the 3' wing segment and wherein each nucleoside of each wing segment comprises a modified sugar.

E17. A compound comprising a modified oligonucleotide 16-80 linked nucleobases in length having a nucleobase sequence comprising the sequence recited in any one of SEQ ID NOs: 2-7, wherein the modified oligonucleotide comprises:
a gap segment consisting of ten linked 2'-deoxynucleosides;
a 5' wing segment consisting of three linked nucleosides; and
a 3' wing segment consisting of three linked nucleosides;
wherein the gap segment is positioned between the 5' wing segment and the 3' wing segment; wherein each nucleoside of each wing segment comprises a cEt nucleoside; wherein each internucleoside linkage is a phosphorothioate linkage; and wherein each cytosine is a 5-methylcytosine.

E18. The compound of any one of embodiments E1-E17, wherein the oligonucleotide is at least 80%, 85%, 90%, 95% or 100% complementary to SEQ ID NO: 1.

E19. The compound of any one of embodiments E1-E18, wherein the compound is single-stranded.

E20. The compound of any one of embodiments E1-E18, wherein the compound is double-stranded.

E21. The compound of any one of embodiments E1-E20, wherein the compound comprises ribonucleotides.

E22. The compound of any one of embodiments E1-E20, wherein the compound comprises deoxyribonucleotides.

E23. The compound of any one of embodiments E1-E22, wherein the modified oligonucleotide consists of 16 to 30 linked nucleosides.

E24. The compound of any preceding embodiments, wherein the compound consists of the modified oligonucleotide.

E25. A compound consisting of a pharmaceutically acceptable salt of any of the compounds of embodiments E1-E24.

E26. The compound of embodiment 25, wherein the pharmaceutically acceptable salt is a sodium salt.

E27. The compound of embodiment 26, wherein the pharmaceutically acceptable salt is a potassium salt.

E28. A modified oligonucleotide according to the following chemical structure:
(SEQ ID NO: 6)
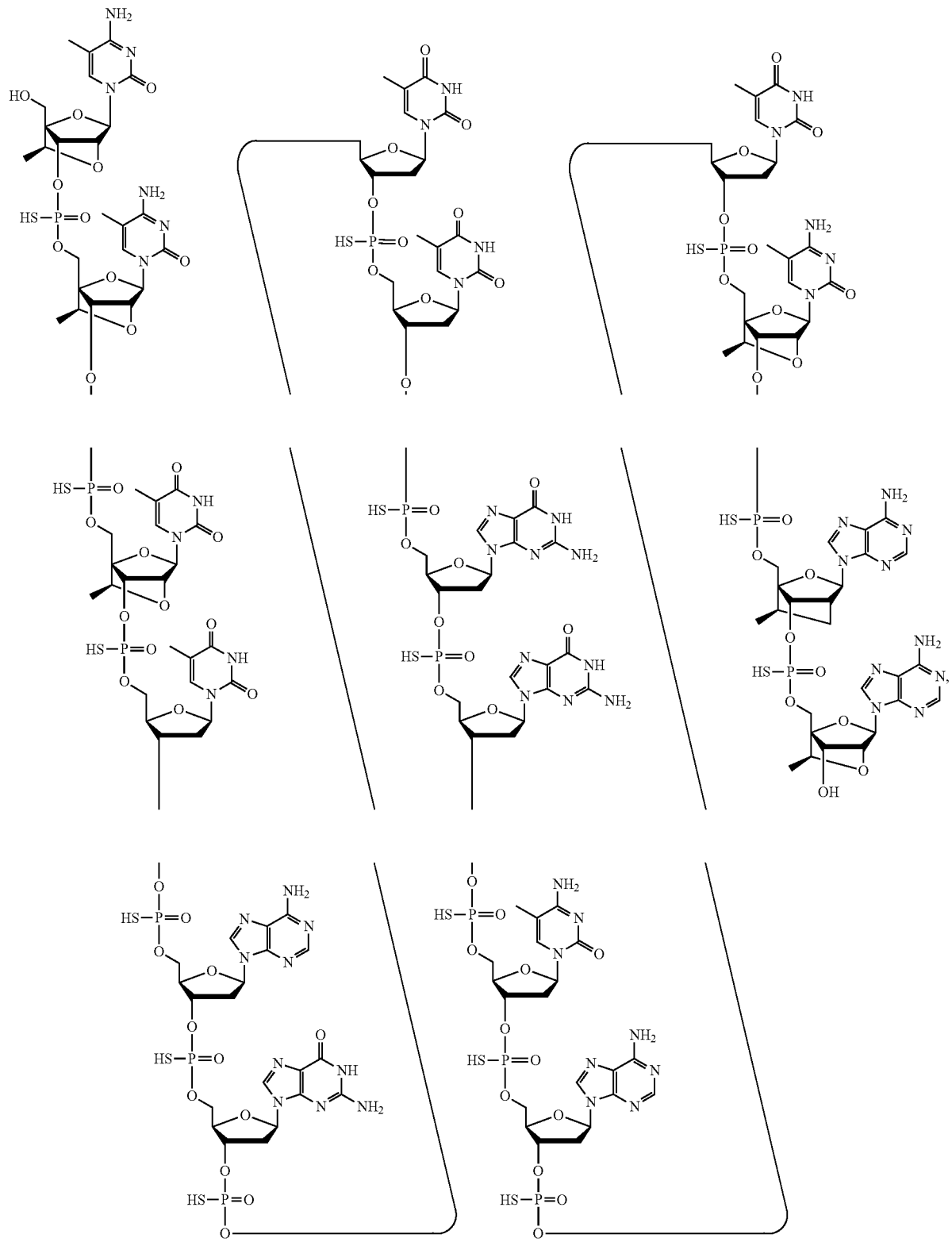
or a salt thereof.

E29. The modified oligonucleotide of embodiment E28, wherein the modified oligonucleotide is the sodium salt or the potassium salt.

E30. A modified oligonucleotide according to the following chemical structure:

E31. A composition comprising the compound of any one of embodiments E1-E27 or the modified oligonucleotide of any one of embodiments E28-E30 and a pharmaceutically acceptable diluent or carrier.

(SEQ ID NO: 6)

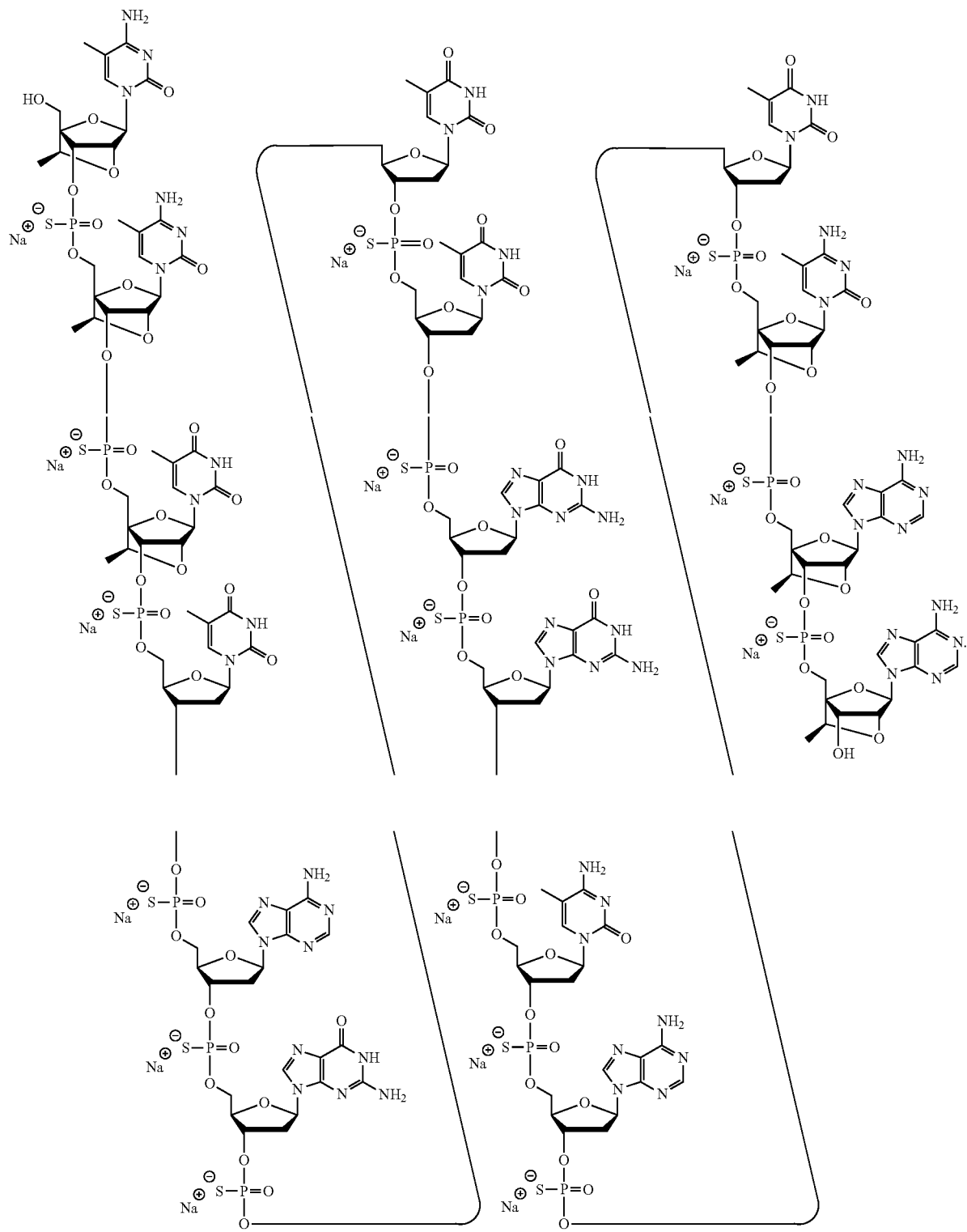

E32. A composition comprising the compound of any one of embodiments E1-E27 or the modified oligonucleotide of any one of embodiments E28-E30 and water.

E33. A composition comprising the compound of any one of embodiments E1-E27 or the modified oligonucleotide of any one of embodiments E28-E30 for use in therapy.

E34. A method of treating or ameliorating cancer in an individual comprising administering to the individual a compound targeted to MALAT1, thereby treating or ameliorating the cancer.

E35. The method of embodiment E34, wherein the compound is an antisense compound targeted to MALAT1.

E36. The method of embodiments E34 or E35, wherein the cancer is breast cancer; inflammatory breast cancer; breast ductal carcinoma; breast lobular carcinoma; luminal A breast cancer; luminal B breast cancer; basal-like breast cancer; HER2 positive (HER2+) breast cancer; HER2 negative (HER2−) breast cancer; Estrogen Receptor negative (ER−) breast cancer; Estrogen Receptor positive (ER+) breast cancer; Progesterone Receptor negative (PR−) breast cancer; Progesterone Receptor positive (PR+) breast cancer; ER positive (ER+) and PR positive (PR+) breast cancer; ER positive (ER+) and PR negative (PR−) breast cancer; ER negative (ER−) and PR positive (PR+) breast cancer; ER positive (ER+) and HER2 negative (HER2−) breast cancer; ER−, PR−, and HER2− triple negative breast cancer (ER−, PR−, HER2−; TNBC); hormone receptor negative breast cancer (ER− and PR−); ER+, PR+, and HER2+ triple positive breast cancer (ER+, PR+, HER2+; TPBC); hepatocellular carcinoma (HCC); head and neck squamous cell carcinoma (HNSCC); oral tongue squamous cell carcinoma (OTSCC); sarcomas (e.g. epitheloid, rhabdoid and synovial); esophageal cancer; gastric cancer; ovarian cancer; pancreatic cancer; lung cancer; non-small cell lung carcinoma (NSCLC); small-cell lung carcinoma (SCLC); squamous cell carcinoma (SCC); head and neck cancer; head and neck squamous cell carcinoma (HNSCC); gastrointestinal cancer; large intestinal cancer; small intestinal cancer; stomach cancer; colon cancer; colorectal cancer; bladder cancer; liver cancer; biliary tract cancer; urothelial cancer; endometrial cancer; cervical cancer; prostate cancer; mesothelioma; chordoma; renal cancer; renal cell carcinoma (RCC); brain cancer; neuroblastoma; glioblastoma; skin cancer; melanoma; basal cell carcinoma; merkel cell carcinoma; blood cancer; hematopoetic cancer; myeloma; multiple myeloma (MM); B cell malignancies; lymphoma; B cell lymphoma; Hodgkin lymphoma; T cell lymphoma; leukemia; or acute lymphocytic leukemia (ALL).

E37. The method of any of embodiments E34-E36, wherein administering the compound inhibits or reduces cancer cell proliferation, cancer cell migration, cancer cell branching morphogenesis, tumor progression, tumor growth, or metastasis.

E38. The method of any of embodiments E34-E37, wherein administering the compound increases or induces cancer cell differentiation, cancer cell adhesion, or tumor differentiation.

E39. The method of any of embodiments E34-E38, wherein administering the compound induces a cancer cell or tumor to have a cystic, ductular, or acinar phenotype or morphology.

E40. The method of any of embodiments E34-E39, wherein administering the compound induces a cancer cell or tumor to have a more differentiated phenotype or structure.

E41. The method of embodiment E40, wherein the more differentiated phenotype or structure comprises presence of secretory lipid droplets, increased desmosomal structures, polarized ductal structures, or increased levels of E-cadherin or casein.

E42. A method of inhibiting expression of MALAT1 in a cancer cell comprising contacting the cancer cell with a compound targeted to MALAT1, thereby inhibiting expression of MALAT1 in the cancer cell.

E43. The method of embodiment E42, wherein the cancer is breast cancer; inflammatory breast cancer; breast ductal carcinoma; breast lobular carcinoma; luminal A breast cancer; luminal B breast cancer; basal-like breast cancer; HER2 positive (HER2+) breast cancer; HER2 negative (HER2−) breast cancer; Estrogen Receptor negative (ER−) breast cancer; Estrogen Receptor positive (ER+) breast cancer; Progesterone Receptor negative (PR−) breast cancer; Progesterone Receptor positive (PR+) breast cancer; ER positive (ER+) and PR positive (PR+) breast cancer; ER positive (ER+) and PR negative (PR−) breast cancer; ER negative (ER−) and PR positive (PR+) breast cancer; ER positive (ER+) and HER2 negative (HER2−) breast cancer; ER−, PR−, and HER2− triple negative breast cancer (ER−, PR−, HER2−; TNBC); hormone receptor negative breast cancer (ER− and PR−); ER+, PR+, and HER2+ triple positive breast cancer (ER+, PR+, HER2+; TPBC); hepatocellular carcinoma (HCC); head and neck squamous cell carcinoma (HNSCC); oral tongue squamous cell carcinoma (OTSCC); sarcomas (e.g. epitheloid, rhabdoid and synovial); esophageal cancer; gastric cancer; ovarian cancer; pancreatic cancer; lung cancer; non-small cell lung carcinoma (NSCLC); small-cell lung carcinoma (SCLC); squamous cell carcinoma (SCC); head and neck cancer; head and neck squamous cell carcinoma (HNSCC); gastrointestinal cancer; large intestinal cancer; small intestinal cancer; stomach cancer; colon cancer; colorectal cancer; bladder cancer; liver cancer; biliary tract cancer; urothelial cancer; endometrial cancer; cervical cancer; prostate cancer; mesothelioma; chordoma; renal cancer; renal cell carcinoma (RCC); brain cancer; neuroblastoma; glioblastoma; skin cancer; melanoma; basal cell carcinoma; merkel cell carcinoma; blood cancer; hematopoetic cancer; myeloma; multiple myeloma (MM); B cell malignancies; lymphoma; B cell lymphoma; Hodgkin lymphoma; T cell lymphoma; leukemia; or acute lymphocytic leukemia (ALL).

E44. A method of reducing or inhibiting cancer cell proliferation, cancer cell migration, cancer cell branching morphogenesis, tumor progression, tumor growth, or metastasis in an individual having cancer comprising administering a compound targeted to MALAT1 to the individual, thereby reducing or inhibiting cancer cell proliferation, cancer cell migration, cancer cell branching morphogenesis, tumor progression, tumor growth, or metastasis in the individual.

E45. A method of increasing or inducing cancer cell differentiation, cancer cell adhesion, or tumor differentiation in an individual having cancer comprising administering a compound targeted to MALAT1 to the individual, thereby increasing or inducing cancer cell differentiation, cancer cell adhesion, or tumor differentiation in the individual.

E46. A method of inducing a cancer cell or tumor to have a cystic, ductular, or acinar phenotype or morphology in an individual having cancer comprising administering a compound targeted to MALAT1 to the individual, thereby inducing the cancer cell or tumor to have a cystic, ductular, or acinar phenotype or morphology.

E47. A method of inducing a cancer cell or tumor to have a more differentiated phenotype or structure comprising administering a compound targeted to MALAT1 to the individual, thereby inducing the cancer cell or tumor to have a more differentiated phenotype or structure.

E48. The method of embodiment E47, wherein the more differentiated phenotype or structure comprises presence of secretory lipid droplets, increased desmosomal structures, polarized ductal structures, or increased levels of E-cadherin or casein.

E49. The method of any of embodiments E44-E48, wherein the individual has breast cancer; inflammatory breast cancer; breast ductal carcinoma; breast lobular carcinoma; luminal A breast cancer; luminal B breast cancer; basal-like breast cancer; HER2 positive (HER2+) breast cancer; HER2 negative (HER2−) breast cancer; Estrogen Receptor negative (ER−) breast cancer; Estrogen Receptor positive (ER+) breast cancer; Progesterone Receptor negative (PR−) breast cancer; Progesterone Receptor positive (PR+) breast cancer; ER positive (ER+) and PR positive (PR+) breast cancer; ER positive (ER+) and PR negative (PR−) breast cancer; ER negative (ER−) and PR positive (PR+) breast cancer; ER positive (ER+) and HER2 negative (HER2−) breast cancer; ER−, PR−, and HER2− triple negative breast cancer (ER−, PR−, HER2−; TNBC); hormone receptor negative breast cancer (ER− and PR−); ER+, PR+, and HER2+ triple positive breast cancer (ER+, PR+, HER2+; TPBC); hepatocellular carcinoma (HCC); head and neck squamous cell carcinoma (HNSCC); oral tongue squamous cell carcinoma (OTSCC); sarcomas (e.g. epitheloid, rhabdoid and synovial); esophageal cancer; gastric cancer; ovarian cancer; pancreatic cancer; lung cancer; non-small cell lung carcinoma (NSCLC); small-cell lung carcinoma (SCLC); squamous cell carcinoma (SCC); head and neck cancer; head and neck squamous cell carcinoma (HNSCC); gastrointestinal cancer; large intestinal cancer; small intestinal cancer; stomach cancer; colon cancer; colorectal cancer; bladder cancer; liver cancer; biliary tract cancer; urothelial cancer; endometrial cancer; cervical cancer; prostate cancer; mesothelioma; chordoma; renal cancer; renal cell carcinoma (RCC); brain cancer; neuroblastoma; glioblastoma; skin cancer; melanoma; basal cell carcinoma; merkel cell carcinoma; blood cancer; hematopoetic cancer; myeloma; multiple myeloma (MM); B cell malignancies; lymphoma; B cell lymphoma; Hodgkin lymphoma; T cell lymphoma; leukemia; or acute lymphocytic leukemia (ALL).

E50. The method of any one of embodiments E34-E49, wherein the compound is an antisense compound targeted to MALAT1.

E51. The method of any one of embodiments E34-E49, wherein the compound is the compound of any one of embodiments E1-E27, the modified oligonucleotide of any one of embodiments E28-E30, or the composition of embodiment E31 or E32.

E52. The method of any of embodiments E34-E51, wherein the compound is administered parenterally.

E53. Use of a compound targeted to MALAT1 for treating, preventing, or ameliorating a cancer associated with MALAT1.

E54. The use of embodiment E53, wherein the cancer is breast cancer; inflammatory breast cancer; breast ductal carcinoma; breast lobular carcinoma; luminal A breast cancer; luminal B breast cancer; basal-like breast cancer; HER2 positive (HER2+) breast cancer; HER2 negative (HER2−) breast cancer; Estrogen Receptor negative (ER−) breast cancer; Estrogen Receptor positive (ER+) breast cancer; Progesterone Receptor negative (PR−) breast cancer; Progesterone Receptor positive (PR+) breast cancer; ER positive (ER+) and PR positive (PR+) breast cancer; ER positive (ER+) and PR negative (PR−) breast cancer; ER negative (ER−) and PR positive (PR+) breast cancer; ER positive (ER+) and HER2 negative (HER2−) breast cancer; ER−, PR−, and HER2− triple negative breast cancer (ER−, PR−, HER2−; TNBC); hormone receptor negative breast cancer (ER− and PR−); ER+, PR+, and HER2+ triple positive breast cancer (ER+, PR+, HER2+; TPBC); hepatocellular carcinoma (HCC); head and neck squamous cell carcinoma (HNSCC); oral tongue squamous cell carcinoma (OTSCC); sarcomas (e.g. epitheloid, rhabdoid and synovial); esophageal cancer; gastric cancer; ovarian cancer; pancreatic cancer; lung cancer; non-small cell lung carcinoma (NSCLC); small-cell lung carcinoma (SCLC); squamous cell carcinoma (SCC); head and neck cancer; head and neck squamous cell carcinoma (HNSCC); gastrointestinal cancer; large intestinal cancer; small intestinal cancer; stomach cancer; colon cancer; colorectal cancer; bladder cancer; liver cancer; biliary tract cancer; urothelial cancer; endometrial cancer; cervical cancer; prostate cancer; mesothelioma; chordoma; renal cancer; renal cell carcinoma (RCC); brain cancer; neuroblastoma; glioblastoma; skin cancer; melanoma; basal cell carcinoma; merkel cell carcinoma; blood cancer; hematopoetic cancer; myeloma; multiple myeloma (MM); B cell malignancies; lymphoma; B cell lymphoma; Hodgkin lymphoma; T cell lymphoma; leukemia; or acute lymphocytic leukemia (ALL).

E55. The use of embodiment E53 or E54, wherein the compound is an antisense compound targeted to MALAT1.

E56. The use of any one of embodiments E53-E55, wherein the compound is the compound of any one of embodiments E1-E27, the modified oligonucleotide of any one of embodiments E28-E30, or the composition of embodiment E31 or E32.

E57. Use of a compound targeted to MALAT1 in the manufacture of a medicament for treating or ameliorating a cancer associated with MALAT1.

E58. The use of embodiment E57, wherein the cancer is breast cancer; inflammatory breast cancer; breast ductal carcinoma; breast lobular carcinoma; luminal A breast cancer; luminal B breast cancer; basal-like breast cancer; HER2 positive (HER2+) breast cancer; HER2 negative (HER2−) breast cancer; Estrogen Receptor negative (ER−) breast cancer; Estrogen Receptor positive (ER+) breast cancer; Progesterone Receptor negative (PR−) breast cancer; Progesterone Receptor positive (PR+) breast cancer; ER positive (ER+) and PR positive (PR+) breast cancer; ER positive (ER+) and PR negative (PR−) breast cancer; ER negative (ER−) and PR positive (PR+) breast cancer; ER positive (ER+) and HER2 negative (HER2−) breast cancer; ER−, PR−, and HER2− triple negative breast cancer (ER−, PR−, HER2−; TNBC); hormone receptor negative breast cancer (ER− and PR−); ER+, PR+, and HER2+ triple positive breast cancer (ER+, PR+, HER2+; TPBC); hepatocellular carcinoma (HCC); head and neck squamous cell carcinoma (HNSCC); oral tongue squamous cell carcinoma (OTSCC); sarcomas (e.g. epitheloid, rhabdoid and synovial); esophageal cancer; gastric cancer; ovarian cancer; pancreatic cancer; lung cancer; non-small cell lung carcinoma (NSCLC); small-cell lung carcinoma (SCLC); squamous cell carcinoma (SCC); head and neck cancer; head and neck squamous cell carcinoma (HNSCC); gastrointestinal cancer; large intestinal cancer; small intestinal cancer; stomach cancer; colon cancer; colorectal cancer; bladder cancer; liver cancer; biliary tract cancer; urothelial cancer; endometrial cancer; cervical cancer; prostate cancer; mesothelioma; chordoma; renal cancer; renal cell carcinoma (RCC); brain cancer; neuroblastoma; glioblastoma; skin cancer; melanoma; basal cell carcinoma; merkel cell carcinoma; blood cancer; hematopoetic cancer; myeloma; multiple myeloma (MM); B cell malignancies; lymphoma; B cell lymphoma; Hodgkin lymphoma; T cell lymphoma; leukemia; or acute lymphocytic leukemia (ALL).

E59. The use of embodiment E57 or E58, wherein the compound is an antisense compound targeted to MALAT1.

E60. The use of any one of embodiments E57-E59, wherein the compound is the compound of any one of embodiments E1-E27, the modified oligonucleotide of any one of embodiments E28-E30, or the composition of embodiment E31 or E32.

E61. Use of a compound targeted to MALAT1 in the preparation of a medicament for treating or ameliorating a cancer associated with MALAT1.

E62. The use of embodiment E61, wherein the cancer is breast cancer; inflammatory breast cancer; breast ductal carcinoma; breast lobular carcinoma; luminal A breast cancer; luminal B breast cancer; basal-like breast cancer; HER2 positive (HER2+) breast cancer; HER2 negative (HER2−) breast cancer; Estrogen Receptor negative (ER−) breast cancer; Estrogen Receptor positive (ER+) breast cancer; Progesterone Receptor negative (PR−) breast cancer; Progesterone Receptor positive (PR+) breast cancer; ER positive (ER+) and PR positive (PR+) breast cancer; ER positive (ER+) and PR negative (PR−) breast cancer; ER negative (ER−) and PR positive (PR+) breast cancer; ER positive (ER+) and HER2 negative (HER2−) breast cancer; ER−, PR−, and HER2− triple negative breast cancer (ER−, PR−, HER2−; TNBC); hormone receptor negative breast cancer (ER− and PR−); ER+, PR+, and HER2+ triple positive breast cancer (ER+, PR+, HER2+; TPBC); hepatocellular carcinoma (HCC); head and neck squamous cell carcinoma (HNSCC); oral tongue squamous cell carcinoma (OTSCC); sarcomas (e.g. epitheloid, rhabdoid and synovial); esophageal cancer; gastric cancer; ovarian cancer; pancreatic cancer; lung cancer; non-small cell lung carcinoma (NSCLC); small-cell lung carcinoma (SCLC); squamous cell carcinoma (SCC); head and neck cancer; head and neck squamous cell carcinoma (HNSCC); gastrointestinal cancer; large intestinal cancer; small intestinal cancer; stomach cancer; colon cancer; colorectal cancer; bladder cancer; liver cancer; biliary tract cancer; urothelial cancer; endometrial cancer; cervical cancer; prostate cancer; mesothelioma; chordoma; renal cancer; renal cell carcinoma (RCC); brain cancer; neuroblastoma; glioblastoma; skin cancer; melanoma; basal cell carcinoma; merkel cell carcinoma; blood cancer; hematopoetic cancer; myeloma; multiple myeloma (MM); B cell malignancies; lymphoma; B cell lymphoma; Hodgkin lymphoma; T cell lymphoma; leukemia; or acute lymphocytic leukemia (ALL).

E63. The use of embodiment E61 or E62, wherein the compound is an antisense compound targeted to MALAT1.

E64. The use of any one of embodiments E61-E63, wherein the compound is the compound of any one of embodiments E1-E27, the modified oligonucleotide of any one of embodiments E28-E30, or the composition of embodiment E31 or E32.

Certain Indications

Certain embodiments provided herein relate to methods of inhibiting MALAT1 expression, which can be useful for treating, preventing, or ameliorating a cancer associated with MALAT1 in an individual, by administration of a compound that targets MALAT1. In certain embodiments, the compound can be a MALAT1 specific inhibitor. In certain embodiments, the compound can be an antisense compound, oligomeric compound, or oligonucleotide targeted to MALAT1.

Examples of cancers associated with MALAT1 treatable, preventable, and/or ameliorable with the compounds and methods provided herein include breast cancer; inflammatory breast cancer; breast ductal carcinoma; breast lobular carcinoma; luminal A breast cancer; luminal B breast cancer; basal-like breast cancer; HER2 positive (HER2+) breast cancer; HER2 negative (HER2−) breast cancer; Estrogen Receptor negative (ER−) breast cancer; Estrogen Receptor positive (ER+) breast cancer; Progesterone Receptor negative (PR−) breast cancer; Progesterone Receptor positive (PR+) breast cancer; ER positive (ER+) and PR positive (PR+) breast cancer; ER positive (ER+) and PR negative (PR−) breast cancer; ER negative (ER−) and PR positive (PR+) breast cancer; ER positive (ER+) and HER2 negative (HER2−) breast cancer; ER−, PR−, and HER2− triple negative breast cancer (ER−, PR−, HER2−; TNBC); hormone receptor negative breast cancer (ER− and PR−); ER+, PR+, and HER2+ triple positive breast cancer (ER+, PR+, HER2+; TPBC); hepatocellular carcinoma (HCC); head and neck squamous cell carcinoma (HNSCC); oral tongue squamous cell carcinoma (OTSCC); sarcomas (e.g. epitheloid, rhabdoid and synovial); esophageal cancer; gastric cancer; ovarian cancer; pancreatic cancer; lung cancer; non-small cell lung carcinoma (NSCLC); small-cell lung carcinoma (SCLC); squamous cell carcinoma (SCC); head and neck cancer; head and neck squamous cell carcinoma (HNSCC); gastrointestinal cancer; large intestinal cancer; small intestinal cancer; stomach cancer; colon cancer; colorectal cancer; bladder cancer; liver cancer; biliary tract cancer; urothelial cancer; endometrial cancer; cervical cancer; prostate cancer; mesothelioma; chordoma; renal cancer; renal cell carcinoma (RCC); brain cancer; neuroblastoma; glioblastoma; skin cancer; melanoma; basal cell carcinoma; merkel cell carcinoma; blood cancer; hematopoetic cancer; myeloma; multiple myeloma (MM); B cell malignancies; lymphoma; B cell lymphoma; Hodgkin lymphoma; T cell lymphoma; leukemia; or acute lymphocytic leukemia (ALL).

In certain embodiments, the breast cancer has one or more of the following characteristics: Androgen Receptor positive, dependent on androgen for growth; Estrogen Receptor (ER) negative, independent of estrogen for growth; Progesterone Receptor (PR) negative, independent of progesterone for growth; or Her2/neu negative. In certain embodiments, the breast cancer is ER, PR, and HER2 triple negative (ER−, PR−, HER2−). In certain embodiments, the breast cancer is triple negative and AR positive (ER−, PR−, HER2−, AR+). In certain embodiments, the breast cancer is ER negative and AR positive (ER−, AR+). In certain embodiments, the breast cancer is ER positive and AR positive (ER+, AR+). In certain embodiments, the breast cancer is apocrine. Apocrine breast cancers are often "triple negative", meaning that the cells do not express ER, PR, or HER2 receptors, and usually, but not necessarily, AR positive. In certain embodiments, an apocrine breast cancer is ER, PR, and HER2 triple negative and AR positive (ER−, PR−, HER2−, AR+). In certain embodiments, an apocrine breast cancer is ER negative and AR positive (ER−, AR+). In certain embodiments, an apocrine breast cancer originates from the sweat gland of the breast. In certain embodiments, an apocrine breast cancer is a ductal cancer or cancer cell of the breast. In certain embodiments, an apocrine breast cancer can have any one or more of the following features: a large amount of eosinophilic granular cytoplasm, well-defined margins, large vesicular nuclei, a nuclear to cytoplasmic ratio of about 1:2, and/or accumulations of secreted granules in the apical cytoplasm known as apical snouts. In certain embodiments, the breast cancer is an ER negative and AR positive (ER−, AR+) molecular apocrine breast cancer. In certain aspects, an ER negative and AR positive (ER−, AR+) molecular apocrine breast cancer can further be PR positive, PR negative, HER2 negative, or HER2 positive. In certain embodiments, the breast cancer is HER2 positive. In certain embodiments, the breast cancer is PR positive. In certain embodiments, the breast cancer is ER positive. Breast cancer can be identified as positive or negative with respect to hormone receptors, such as ER, PR, or HER2 by standard histological techniques. For example, in some embodiments histological breast cancer samples can be classified as "triple negative" (ER−, PR−, HER2−) when less than 1% of cells demonstrate nuclear staining for estrogen and progesterone receptors, and immunohistochemical staining for HER2 shows a 0, 1-fold, or a 2-fold positive score and a FISH ratio (HER2 gene signals to chromosome 17 signals) of less than 1.8 according to the relevant ASCO and CAP guidelines. (Meyer, P. et al., PLoS ONE 7(5): e38361 (2012)).

In certain embodiments, the B-cell lymphoma is a non-Hodgkin's B-cell lymphoma. Examples of non-Hodgkin's B-cell lymphoma of certain embodiments that can be treated with compounds provided herein include, but are not limited to, diffuse large B cell lymphoma (DLBCL), activated B-cell lymphoma (ABC-DLBCL), germinal center B-cell lymphoma (GCB DLBCL), follicular lymphoma, mucosa-associated lymphatic tissue lymphoma (MALT), small cell lymphocytic lymphoma, chronic lymphocytic leukemia, mantle cell lymphoma (MCL), Burkitt lymphoma, mediastinal large B cell lymphoma, Waldenstrom macroglobulinemia, nodal marginal zone B cell lymphoma (NMZL), splenic marginal zone lymphoma (SMZL), intravascular large B-cell lymphoma, primary effusion lymphoma, and lymphomatoid granulomatosis.

In certain embodiments, the T-cell lymphoma that can be treated with compounds provided herein include, but are not limited to, peripheral T-cell lymphoma, and anaplastic large cell lymphoma (ALCL).

In certain embodiments, the leukemia that can be treated with compounds provided herein includes, but is not limited to, acute lymphocytic leukemia (ALL).

In certain embodiments, a method of treating, preventing, or ameliorating a cancer associated with MALAT1 in an individual comprises administering to the individual a compound comprising a MALAT1 specific inhibitor, thereby treating, preventing, or ameliorating the cancer. In certain embodiments, the compound comprises an antisense compound targeted to MALAT1. In certain embodiments, the compound comprises an oligonucleotide targeted to MALAT1. In certain embodiments, a compound comprises a modified oligonucleotide consisting of 8 to 80 linked nucleosides and having a nucleobase sequence comprising at least 8 contiguous nucleobases of any of the nucleobase sequences of SEQ ID NOs: 2-10. In certain embodiments, a compound comprises a modified oligonucleotide consisting of 16 to 80 linked nucleosides and having a nucleobase sequence comprising the nucleobase sequence of any one of SEQ ID NOs: 2-10. In certain embodiments, a compound comprises a modified oligonucleotide consisting of the nucleobase sequence of any one of SEQ ID NOs: 2-10. In certain embodiments, a compound comprises a modified oligonucleotide consisting of 8 to 80 linked nucleosides and having a nucleobase sequence comprising at least 8 contiguous nucleobases of any of the nucleobase sequences of SEQ ID NOs: 36-2646 or 2664-2813. In certain embodiments, a compound comprises a modified oligonucleotide consisting of 16 to 80 linked nucleosides and having a nucleobase sequence comprising the nucleobase sequence of any one of SEQ ID NOs: 36-2646 or 2664-2813. In certain embodiments, a compound comprises a modified oligonucleotide consisting of the nucleobase sequence of any one of SEQ ID NOs: SEQ ID NOs: 36-2646 or 2664-2813. In any of the foregoing embodiments, the modified oligonucleotide can consist of 10 to 30 linked nucleosides. In certain embodiments, the compound is ION 1157034, 1157111, 1157190, 1157929, 1158161, 1158162, 1304884, 1304890, or 1304906. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound inhibits or reduces cancer cell proliferation, cancer cell migration, cancer cell branching morphogenesis, tumor progression, tumor growth, or metastasis. In certain embodiments, administering the compound increases or induces cancer cell differentiation, cancer cell adhesion, or tumor differentiation. In certain embodiments, administering the compound induces a breast cancer cell or breast tumor to have a cystic, ductular, or acinar phenotype or morphology. In certain embodiments, administering the compound induces a breast cancer cell or breast tumor to have a more differentiated phenotype or structure. In certain embodiments, the more differentiated phenotype or structure includes, but is not limited to, presence of secretory lipid droplets, increased desmosomal structures, polarized ductal structures, or increased levels of differentiation markers such as E-cadherin or milk proteins such as casein.

In certain embodiments, a method of treating or ameliorating cancer comprises administering to the individual a compound comprising a MALAT1 specific inhibitor, thereby treating or ameliorating the cancer. In certain embodiments, the cancer is breast cancer; inflammatory breast cancer; breast ductal carcinoma; breast lobular carcinoma; luminal A breast cancer; luminal B breast cancer; basal-like breast cancer; HER2 positive (HER2+) breast cancer; HER2 negative (HER2−) breast cancer; Estrogen Receptor negative (ER−) breast cancer; Estrogen Receptor positive (ER+) breast cancer; Progesterone Receptor negative (PR−) breast cancer; Progesterone Receptor positive (PR+) breast cancer; ER positive (ER+) and PR positive (PR+) breast cancer; ER positive (ER+) and PR negative (PR−) breast cancer; ER negative (ER−) and PR positive (PR+) breast cancer; ER positive (ER+) and HER2 negative (HER2−) breast cancer; ER−, PR−, and HER2− triple negative breast cancer (ER−, PR−, HER2−; TNBC); hormone receptor negative breast cancer (ER− and PR−); ER+, PR+, and HER2+ triple positive breast cancer (ER+, PR+, HER2+; TPBC); hepatocellular carcinoma (HCC); head and neck squamous cell carcinoma (HNSCC); oral tongue squamous cell carcinoma (OTSCC); sarcomas (e.g. epitheloid, rhabdoid and synovial); esophageal cancer; gastric cancer; ovarian cancer; pancreatic cancer; lung cancer; non-small cell lung carcinoma (NSCLC); small-cell lung carcinoma (SCLC); squamous cell carcinoma (SCC); head and neck cancer; head and neck squamous cell carcinoma (HNSCC); gastrointestinal cancer; large intestinal cancer; small intestinal cancer; stomach cancer; colon cancer; colorectal cancer; bladder cancer; liver cancer; biliary tract cancer; urothelial cancer; endometrial cancer; cervical cancer; prostate cancer; mesothelioma; chordoma; renal cancer; renal cell carcinoma (RCC); brain cancer; neuroblastoma; glioblastoma; skin cancer; melanoma; basal cell carcinoma; merkel cell carcinoma; blood cancer; hematopoetic cancer; myeloma; multiple myeloma (MM); B cell malignancies; lymphoma; B cell lymphoma; Hodgkin lymphoma; T cell lymphoma; leukemia; or acute lymphocytic leukemia (ALL). In certain embodiments, the compound comprises an antisense compound targeted to MALAT1. In certain embodiments, the compound comprises an oligonucleotide targeted to MALAT1. In certain embodiments, the compound comprises a modified oligonucleotide consisting of 8 to 80 linked nucleosides and having a nucleobase sequence comprising at least 8 contiguous nucleobases of any of the nucleobase sequences of SEQ ID NOs: 2-10. In certain embodiments, the compound comprises a modified oligonucleotide consisting of 16 to 80 linked nucleosides and having a nucleobase sequence comprising the nucleobase sequence of any one of SEQ ID NOs: 2-10. In certain embodiments, the compound comprises a modified oligonucleotide consisting of the nucleobase sequence of any one of SEQ ID NOs: 2-10. In certain embodiments, a compound comprises a modified oligonucleotide consisting of 8 to 80 linked nucleosides and having a nucleobase sequence comprising at least 8 contiguous nucleobases of any of the nucleobase sequences of SEQ ID NOs: 36-2646 or 2664-2813. In certain embodiments, a compound comprises a modified oligonucleotide consisting of 16 to 80 linked nucleosides and having a nucleobase sequence comprising the nucleobase sequence of any one of SEQ ID NOs: 36-2646 or 2664-2813. In certain embodiments, a compound comprises a modified oligonucleotide consisting of the nucleobase sequence of any one of SEQ ID NOs: SEQ ID NOs: 36-2646 or 2664-2813. In any of the foregoing embodiments, the modified oligonucleotide can consist of 10 to 30 linked nucleosides. In certain embodiments, the compound is ION 1157034, 1157111, 1157190, 1157929, 1158161, 1158162, 1304884, 1304890, or 1304906. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound inhibits or reduces cancer cell proliferation, cancer cell migration, cancer cell branching morphogenesis, tumor progression, tumor growth, or metastasis. In certain embodiments, administering the compound increases or induces cancer cell differentiation, cancer cell adhesion, or tumor differentiation. In certain embodiments, administering the compound induces a breast cancer cell or breast tumor to have a cystic, ductular, or acinar phenotype or morphology. In certain embodiments, administering the compound induces a breast cancer cell or breast tumor to have a more differentiated phenotype or structure. In certain embodiments, the more differentiated phenotype or structure includes, but is not limited to, presence of secretory lipid droplets, increased desmosomal structures, polarized ductal structures, or increased levels of differentiation markers such as E-cadherin or milk proteins such as casein.

In certain embodiments, the individual is identified as having or at risk of having a cancer associated with MALAT1.

In certain embodiments, a method of inhibiting expression of MALAT1 in an individual having, or at risk of having, a cancer associated with MALAT1 comprises administering to the individual a compound comprising a MALAT1 specific inhibitor, thereby inhibiting expression of MALAT1 in the individual. In certain embodiments, administering the compound inhibits expression of MALAT1 in the breast. In certain embodiments, the individual has, or is at risk of having breast cancer; inflammatory breast cancer; breast ductal carcinoma; breast lobular carcinoma; luminal A breast cancer; luminal B breast cancer; basal-like breast cancer; HER2 positive (HER2+) breast cancer; HER2 negative (HER2−) breast cancer; Estrogen Receptor negative (ER−) breast cancer; Estrogen Receptor positive (ER+) breast cancer; Progesterone Receptor negative (PR−) breast cancer; Progesterone Receptor positive (PR+) breast cancer; ER positive (ER+) and PR positive (PR+) breast cancer; ER positive (ER+) and PR negative (PR−) breast cancer; ER negative (ER−) and PR positive (PR+) breast cancer; ER positive (ER+) and HER2 negative (HER2−) breast cancer; ER−, PR−, and HER2− triple negative breast cancer (ER−, PR−, HER2−; TNBC); hormone receptor negative breast cancer (ER− and PR−); ER+, PR+, and HER2+ triple positive breast cancer (ER+, PR+, HER2+; TPBC); hepatocellular carcinoma (HCC); head and neck squamous cell carcinoma (HNSCC); oral tongue squamous cell carcinoma (OTSCC); sarcomas (e.g. epitheloid, rhabdoid and synovial); esophageal cancer; gastric cancer; ovarian cancer; pancreatic cancer; lung cancer; non-small cell lung carcinoma (NSCLC); small-cell lung carcinoma (SCLC); squamous cell carcinoma (SCC); head and neck cancer; head and neck squamous cell carcinoma (HNSCC); gastrointestinal cancer; large intestinal cancer; small intestinal cancer; stomach cancer; colon cancer; colorectal cancer; bladder cancer; liver cancer; biliary tract cancer; urothelial cancer; endometrial cancer; cervical cancer; prostate cancer; mesothelioma; chordoma; renal cancer; renal cell carcinoma (RCC); brain cancer; neuroblastoma; glioblastoma; skin cancer; melanoma; basal cell carcinoma; merkel cell carcinoma; blood cancer; hematopoetic cancer; myeloma; multiple myeloma (MM); B cell malignancies; lymphoma; B cell lymphoma; Hodgkin lymphoma; T cell lymphoma; leukemia; or acute lymphocytic leukemia (ALL). In certain embodiments, the compound comprises an antisense compound targeted to MALAT1. In certain embodiments, the compound comprises an oligonucleotide targeted to MALAT1. In certain embodiments, the compound comprises a modified oligonucleotide consisting of 8 to 80 linked nucleosides and having a nucleobase sequence comprising at least 8 contiguous nucleobases of any of the nucleobase sequences of SEQ ID NOs: 2-10. In certain embodiments, the compound comprises a modified oligonucleotide consisting of 16 to 80 linked nucleosides and having a nucleobase sequence comprising the nucleobase sequence of any one of SEQ ID NOs: 2-10. In certain embodiments, the compound comprises a modified oligonucleotide consisting of the nucleobase sequence of any one of SEQ ID NOs: 2-10. In certain embodiments, a compound comprises a modified oligonucleotide consisting of 8 to 80 linked nucleosides and having a nucleobase sequence comprising at least 8 contiguous nucleobases of any of the nucleobase sequences of SEQ ID NOs: 36-2646 or 2664-2813. In certain embodiments, a compound comprises a modified oligonucleotide consisting of 16 to 80 linked nucleosides and having a nucleobase sequence comprising the nucleobase sequence of any one of SEQ ID NOs: 36-2646 or 2664-2813. In certain embodiments, a compound comprises a modified oligonucleotide consisting of the nucleobase sequence of any one of SEQ ID NOs: SEQ ID NOs: 36-2646 or 2664-2813. In any of the foregoing embodiments, the modified oligonucleotide can consist of 10 to 30 linked nucleosides. In certain embodiments, the compound is ION 1157034, 1157111, 1157190, 1157929, 1158161, 1158162, 1304884, 1304890, or 1304906. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound inhibits or reduces cancer cell proliferation, cancer cell migration, cancer cell branching morphogenesis, tumor progression, tumor growth, or metastasis. In certain embodiments, administering the compound increases or induces cancer cell differentiation, cancer cell adhesion, or tumor differentiation. In certain embodiments, administering the compound induces a breast cancer cell or breast tumor to have a cystic, ductular, or acinar phenotype or morphology. In certain embodiments, administering the compound induces a breast cancer cell or breast tumor to have a more differentiated phenotype or structure. In certain embodiments, the more differentiated phenotype or structure includes, but is not limited to, presence of secretory lipid droplets, increased desmosomal structures, polarized ductal structures, or increased levels of differentiation markers such as E-cadherin or milk proteins such as casein.

In certain embodiments, the individual is identified as having or at risk of having a cancer associated with MALAT1.

In certain embodiments, a method of inhibiting expression of MALAT1 in a cell comprises contacting the cell with a compound comprising a MALAT1 specific inhibitor, thereby inhibiting expression of MALAT1 in the cell. In certain embodiments, the cell is a cancer cell. In certain embodiments, the cell is a breast cell. In certain embodiments, the cell is in the breast. In certain embodiments, the cell is in the breast of an individual who has, or is at risk of having cancer, such as breast cancer; inflammatory breast cancer; breast ductal carcinoma; breast lobular carcinoma; luminal A breast cancer; luminal B breast cancer; basal-like breast cancer; HER2 positive (HER2+) breast cancer; HER2 negative (HER2−) breast cancer; Estrogen Receptor negative (ER−) breast cancer; Estrogen Receptor positive (ER+) breast cancer; Progesterone Receptor negative (PR−) breast cancer; Progesterone Receptor positive (PR+) breast cancer; ER positive (ER+) and PR positive (PR+) breast cancer; ER positive (ER+) and PR negative (PR−) breast cancer; ER negative (ER−) and PR positive (PR+) breast cancer; ER positive (ER+) and HER2 negative (HER2−) breast cancer; ER−, PR−, and HER2− triple negative breast cancer (ER−, PR−, HER2−; TNBC); hormone receptor negative breast cancer (ER− and PR−); ER+, PR+, and HER2+ triple positive breast cancer (ER+, PR+, HER2+; TPBC); hepatocellular carcinoma (HCC); head and neck squamous cell carcinoma (HNSCC); oral tongue squamous cell carcinoma (OTSCC); sarcomas (e.g. epitheloid, rhabdoid and synovial); esophageal cancer; gastric cancer; ovarian cancer; pancreatic cancer; lung cancer; non-small cell lung carcinoma (NSCLC); small-cell lung carcinoma (SCLC); squamous cell carcinoma (SCC); head and neck cancer; head and neck squamous cell carcinoma (HNSCC); gastrointestinal cancer; large intestinal cancer; small intestinal cancer; stomach cancer; colon cancer; colorectal cancer; bladder cancer; liver cancer; biliary tract cancer; urothelial cancer; endometrial cancer; cervical cancer; prostate cancer; mesothelioma; chordoma; renal cancer; renal cell carcinoma (RCC); brain cancer; neuroblastoma; glioblastoma; skin cancer; melanoma; basal cell carcinoma; merkel cell carcinoma; blood cancer; hematopoetic cancer; myeloma; multiple myeloma (MM); B cell malignancies; lymphoma; B cell lymphoma; Hodgkin lymphoma; T cell lymphoma; leukemia; or acute lymphocytic leukemia (ALL). In certain embodiments, the compound comprises an antisense compound targeted to MALAT1. In certain embodiments, the compound comprises an oligonucleotide targeted to MALAT1. In certain embodiments, the compound comprises a modified oligonucleotide consisting of 8 to 80 linked nucleosides and having a nucleobase sequence comprising at least 8 contiguous nucleobases of any of the nucleobase sequences of SEQ ID NOs: 2-10. In certain embodiments, the compound comprises a modified oligonucleotide consisting of 16 to 80 linked nucleosides and having a nucleobase sequence comprising the nucleobase sequence of any one of SEQ ID NOs: 2-10. In certain embodiments, the compound comprises a modified oligonucleotide consisting of the nucleobase sequence of any one of SEQ ID NOs: 2-10. In certain embodiments, a compound comprises a modified oligonucleotide consisting of 8 to 80 linked nucleosides and having a nucleobase sequence comprising at least 8 contiguous nucleobases of any of the nucleobase sequences of SEQ ID NOs: 36-2646 or 2664-2813. In certain embodiments, a compound comprises a modified oligonucleotide consisting of 16 to 80 linked nucleosides and having a nucleobase sequence comprising the nucleobase sequence of any one of SEQ ID NOs: 36-2646 or 2664-2813. In certain embodiments, a compound comprises a modified oligonucleotide consisting of the nucleobase sequence of any one of SEQ ID NOs: SEQ ID NOs: 36-2646 or 2664-2813. In any of the foregoing embodiments, the modified oligonucleotide can consist of 10 to 30 linked nucleosides. In certain embodiments, the compound is ION 1157034, 1157111, 1157190, 1157929, 1158161, 1158162, 1304884, 1304890, or 1304906. In any of the foregoing embodiments, the compound can be single-stranded or double-stranded. In any of the foregoing embodiments, the compound can be an antisense compound or oligomeric compound.

In certain embodiments, a method of reducing or inhibiting cancer cell proliferation, cancer cell migration, cancer cell branching morphogenesis, tumor progression, tumor growth, or metastasis of an individual having, or at risk of having, a cancer associated with MALAT1 comprises administering to the individual a compound comprising a MALAT1 specific inhibitor, thereby reducing or inhibiting cancer cell proliferation, cancer cell migration, cancer cell branching morphogenesis, tumor progression, tumor growth, or metastasis in the individual. In certain embodiments, a method of increasing or inducing cancer cell differentiation, cancer cell adhesion, or tumor differentiation of an individual having, or at risk of having, a cancer associated with MALAT1 comprises administering to the individual a compound comprising a MALAT1 specific inhibitor, thereby increasing or inducing cancer cell differentiation, cancer cell adhesion, or tumor differentiation in the individual. In certain embodiments, administering the compound induces a breast cancer cell or breast tumor to have a cystic, ductular, or acinar phenotype or morphology. In certain embodiments, administering the compound induces a breast cancer cell or breast tumor to have a more differentiated phenotype or structure. In certain embodiments, the more differentiated phenotype or structure includes, but is not limited to, presence of secretory lipid droplets, increased desmosomal structures, polarized ductal structures, or increased levels of differentiation markers such as E-cadherin or milk proteins such as casein. In certain embodiments, the individual has, or is at risk of having, breast cancer; inflammatory breast cancer; breast ductal carcinoma; breast lobular carcinoma; luminal A breast cancer; luminal B breast cancer; basal-like breast cancer; HER2 positive (HER2+) breast cancer; HER2 negative (HER2−) breast cancer; Estrogen Receptor negative (ER−) breast cancer; Estrogen Receptor positive (ER+) breast cancer; Progesterone Receptor negative (PR−) breast cancer; Progesterone Receptor positive (PR+) breast cancer; ER positive (ER+) and PR positive (PR+) breast cancer; ER positive (ER+) and PR negative (PR−) breast cancer; ER negative (ER−) and PR positive (PR+) breast cancer; ER positive (ER+) and HER2 negative (HER2−) breast cancer; ER−, PR−, and HER2− triple negative breast cancer (ER−, PR−, HER2−; TNBC); hormone receptor negative breast cancer (ER− and PR−); ER+, PR+, and HER2+ triple positive breast cancer (ER+, PR+, HER2+; TPBC); hepatocellular carcinoma (HCC); head and neck squamous cell carcinoma (HNSCC); oral tongue squamous cell carcinoma (OTSCC); sarcomas (e.g. epitheloid, rhabdoid and synovial); esophageal cancer; gastric cancer; ovarian cancer; pancreatic cancer; lung cancer; non-small cell lung carcinoma (NSCLC); small-cell lung carcinoma (SCLC); squamous cell carcinoma (SCC); head and neck cancer; head and neck squamous cell carcinoma (HNSCC); gastrointestinal cancer; large intestinal cancer; small intestinal cancer; stomach cancer; colon cancer; colorectal cancer; bladder cancer; liver cancer; biliary tract cancer; urothelial cancer; endometrial cancer; cervical cancer; prostate cancer; mesothelioma; chordoma; renal cancer; renal cell carcinoma (RCC); brain cancer; neuroblastoma; glioblastoma; skin cancer; melanoma; basal cell carcinoma; merkel cell carcinoma; blood cancer; hematopoetic cancer; myeloma; multiple myeloma (MM); B cell malignancies; lymphoma; B cell lymphoma; Hodgkin lymphoma; T cell lymphoma; leukemia; or acute lymphocytic leukemia (ALL). In certain embodiments, the compound comprises an antisense compound targeted to MALAT1. In certain embodiments, the compound comprises an oligonucleotide targeted to MALAT1. In certain embodiments, the compound comprises a modified oligonucleotide consisting of 8 to 80 linked nucleosides and having a nucleobase sequence comprising at least 8 contiguous nucleobases of any of the nucleobase sequences of SEQ ID NOs: 2-10. In certain embodiments, the compound comprises a modified oligonucleotide consisting of 16 to 80 linked nucleosides and having a nucleobase sequence comprising the nucleobase sequence of any one of SEQ ID NOs: 2-10. In certain embodiments, the compound comprises a modified oligonucleotide consisting of the nucleobase sequence of any one of SEQ ID NOs: 2-10. In certain embodiments, a compound comprises a modified oligonucleotide consisting of 8 to 80 linked nucleosides and having a nucleobase sequence comprising at least 8 contiguous nucleobases of any of the nucleobase sequences of SEQ ID NOs: 36-2646 or 2664-2813. In certain embodiments, a compound comprises a modified oligonucleotide consisting of 16 to 80 linked nucleosides and having a nucleobase sequence comprising the nucleobase sequence of any one of SEQ ID NOs: 36-2646 or 2664-2813. In certain embodiments, a compound comprises a modified oligonucleotide consisting of the nucleobase sequence of any one of SEQ ID NOs: SEQ ID NOs: 36-2646 or 2664-2813. In any of the foregoing embodiments, the modified oligonucleotide can consist of 10 to 30 linked nucleosides. In certain embodiments, the compound is ION 1157034, 1157111, 1157190, 1157929, 1158161, 1158162, 1304884, 1304890, or 1304906. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, the individual is identified as having or at risk of having a cancer associated with MALAT1.

Certain embodiments are drawn to a compound comprising a MALAT1 specific inhibitor for use in treating cancer. In certain embodiments, the cancer is breast cancer; inflammatory breast cancer; breast ductal carcinoma; breast lobular carcinoma; luminal A breast cancer; luminal B breast cancer; basal-like breast cancer; HER2 positive (HER2+) breast cancer; HER2 negative (HER2−) breast cancer; Estrogen Receptor negative (ER−) breast cancer; Estrogen Receptor positive (ER+) breast cancer; Progesterone Receptor negative (PR−) breast cancer; Progesterone Receptor positive (PR+) breast cancer; ER positive (ER+) and PR positive (PR+) breast cancer; ER positive (ER+) and PR negative (PR−) breast cancer; ER negative (ER−) and PR positive (PR+) breast cancer; ER positive (ER+) and HER2 negative (HER2−) breast cancer; ER−, PR−, and HER2− triple negative breast cancer (ER−, PR−, HER2−; TNBC); hormone receptor negative breast cancer (ER− and PR−); ER+, PR+, and HER2+ triple positive breast cancer (ER+, PR+, HER2+; TPBC); hepatocellular carcinoma (HCC); head and neck squamous cell carcinoma (HNSCC); oral tongue squamous cell carcinoma (OTSCC); sarcomas (e.g. epitheloid, rhabdoid and synovial); esophageal cancer; gastric cancer; ovarian cancer; pancreatic cancer; lung cancer; non-small cell lung carcinoma (NSCLC); small-cell lung carcinoma (SCLC); squamous cell carcinoma (SCC); head and neck cancer; head and neck squamous cell carcinoma (HNSCC); gastrointestinal cancer; large intestinal cancer; small intestinal cancer; stomach cancer; colon cancer; colorectal cancer; bladder cancer; liver cancer; biliary tract cancer; urothelial cancer; endometrial cancer; cervical cancer; prostate cancer; mesothelioma; chordoma; renal cancer; renal cell carcinoma (RCC); brain cancer; neuroblastoma; glioblastoma; skin cancer; melanoma; basal cell carcinoma; merkel cell carcinoma; blood cancer; hematopoetic cancer; myeloma; multiple myeloma (MM); B cell malignancies; lymphoma; B cell lymphoma; Hodgkin lymphoma; T cell lymphoma; leukemia; or acute lymphocytic leukemia (ALL). In certain embodiments, the compound comprises an antisense compound targeted to MALAT1. In certain embodiments, the compound comprises an oligonucleotide targeted to MALAT1. In certain embodiments, the compound comprises a modified oligonucleotide consisting of 8 to 80 linked nucleosides and having a nucleobase sequence comprising at least 8 contiguous nucleobases of any of the nucleobase sequences of SEQ ID NOs: 2-10. In certain embodiments, the compound comprises a modified oligonucleotide consisting of 16 to 80 linked nucleosides and having a nucleobase sequence comprising the nucleobase sequence of any one of SEQ ID NOs: 2-10. In certain embodiments, the compound comprises a modified oligonucleotide consisting of the nucleobase sequence of any one of SEQ ID NOs: 2-10. In certain embodiments, a compound comprises a modified oligonucleotide consisting of 8 to 80 linked nucleosides and having a nucleobase sequence comprising at least 8 contiguous nucleobases of any of the nucleobase sequences of SEQ ID NOs: 36-2646 or 2664-2813. In certain embodiments, a compound comprises a modified oligonucleotide consisting of 16 to 80 linked nucleosides and having a nucleobase sequence comprising the nucleobase sequence of any one of SEQ ID NOs: 36-2646 or 2664-2813. In certain embodiments, a compound comprises a modified oligonucleotide consisting of the nucleobase sequence of any one of SEQ ID NOs: SEQ ID NOs: 36-2646 or 2664-2813. In any of the foregoing embodiments, the modified oligonucleotide can consist of 10 to 30 linked nucleosides. In certain embodiments, the compound is ION 1157034, 1157111, 1157190, 1157929, 1158161, 1158162, 1304884, 1304890, or 1304906. In any of the foregoing embodiments, the compound can be single-stranded or double-stranded. In any of the foregoing embodiments, the compound can be an antisense compound or oligomeric compound.

Certain embodiments are drawn to a compound comprising a MALAT1 specific inhibitor for use in reducing or inhibiting cancer cell proliferation, cancer cell migration, cancer cell branching morphogenesis, tumor progression, tumor growth, or metastasis in an individual having cancer. Certain embodiments are drawn to a compound comprising a MALAT1 specific inhibitor for use in increasing or inducing cancer cell differentiation, cancer cell adhesion, or tumor differentiation in an individual having cancer. In certain embodiments, administering the compound induces a breast cancer cell or breast tumor to have a cystic, ductular, or acinar phenotype or morphology. In certain embodiments, administering the compound induces a breast cancer cell or breast tumor to have a more differentiated phenotype or structure. In certain embodiments, the more differentiated phenotype or structure includes, but is not limited to, presence of secretory lipid droplets, increased desmosomal structures, polarized ductal structures, or increased levels of differentiation markers such as E-cadherin or milk proteins such as casein. In certain embodiments, the cancer is breast cancer; inflammatory breast cancer; breast ductal carcinoma; breast lobular carcinoma; luminal A breast cancer; luminal B breast cancer; basal-like breast cancer; HER2 positive (HER2+) breast cancer; HER2 negative (HER2−) breast cancer; Estrogen Receptor negative (ER−) breast cancer; Estrogen Receptor positive (ER+) breast cancer; Progesterone Receptor negative (PR−) breast cancer; Progesterone Receptor positive (PR+) breast cancer; ER positive (ER+) and PR positive (PR+) breast cancer; ER positive (ER+) and PR negative (PR−) breast cancer; ER negative (ER−) and PR positive (PR+) breast cancer; ER positive (ER+) and HER2 negative (HER2−) breast cancer; ER−, PR−, and HER2− triple negative breast cancer (ER−, PR−, HER2−; TNBC); hormone receptor negative breast cancer (ER− and PR−); ER+, PR+, and HER2+ triple positive breast cancer (ER+, PR+, HER2+; TPBC); hepatocellular carcinoma (HCC); head and neck squamous cell carcinoma (HNSCC); oral tongue squamous cell carcinoma (OTSCC); sarcomas (e.g. epitheloid, rhabdoid and synovial); esophageal cancer; gastric cancer; ovarian cancer; pancreatic cancer; lung cancer; non-small cell lung carcinoma (NSCLC); small-cell lung carcinoma (SCLC); squamous cell carcinoma (SCC); head and neck cancer; head and neck squamous cell carcinoma (HNSCC); gastrointestinal cancer; large intestinal cancer; small intestinal cancer; stomach cancer; colon cancer; colorectal cancer; bladder cancer; liver cancer; biliary tract cancer; urothelial cancer; endometrial cancer; cervical cancer; prostate cancer; mesothelioma; chordoma; renal cancer; renal cell carcinoma (RCC); brain cancer; neuroblastoma; glioblastoma; skin cancer; melanoma; basal cell carcinoma; merkel cell carcinoma; blood cancer; hematopoetic cancer; myeloma; multiple myeloma (MM); B cell malignancies; lymphoma; B cell lymphoma; Hodgkin lymphoma; T cell lymphoma; leukemia; or acute lymphocytic leukemia (ALL). In certain embodiments, the compound comprises an antisense compound targeted to MALAT1. In certain embodiments, the compound comprises an oligonucleotide targeted to MALAT1. In certain embodiments, the compound comprises a modified oligonucleotide consisting of 8 to 80 linked nucleosides and having a nucleobase sequence comprising at least 8 contiguous nucleobases of any of the nucleobase sequences of SEQ ID NOs: 2-10. In certain embodiments, the compound comprises a modified oligonucleotide consisting of 16 to 80 linked nucleosides and having a nucleobase sequence comprising the nucleobase sequence of any one of SEQ ID NOs: 2-10. In certain embodiments, the compound comprises a modified oligonucleotide consisting of the nucleobase sequence of any one of SEQ ID NOs: 2-10. In certain embodiments, a compound comprises a modified oligonucleotide consisting of 8 to 80 linked nucleosides and having a nucleobase sequence comprising at least 8 contiguous nucleobases of any of the nucleobase sequences of SEQ ID NOs: 36-2646 or 2664-2813. In certain embodiments, a compound comprises a modified oligonucleotide consisting of 16 to 80 linked nucleosides and having a nucleobase sequence comprising the nucleobase sequence of any one of SEQ ID NOs: 36-2646 or 2664-2813. In certain embodiments, a compound comprises a modified oligonucleotide consisting of the nucleobase sequence of any one of SEQ ID NOs: SEQ ID NOs: 36-2646 or 2664-2813. In any of the foregoing embodiments, the modified oligonucleotide can consist of 10 to 30 linked nucleosides. In certain embodiments, the compound is ION 1157034, 1157111, 1157190, 1157929, 1158161, 1158162, 1304884, 1304890, or 1304906. In any of the foregoing embodiments, the compound can be single-stranded or double-stranded. In any of the foregoing embodiments, the compound can be an antisense compound or oligomeric compound.

Certain embodiments are drawn to use of a compound comprising a MALAT1 specific inhibitor for the manufacture or preparation of a medicament for treating cancer. Certain embodiments are drawn to use of a compound comprising a MALAT1 specific inhibitor for the preparation of a medicament for treating a cancer associated with MALAT1. In certain embodiments, the cancer is breast cancer; inflammatory breast cancer; breast ductal carcinoma; breast lobular carcinoma; luminal A breast cancer; luminal B breast cancer; basal-like breast cancer; HER2 positive (HER2+) breast cancer; HER2 negative (HER2−) breast cancer; Estrogen Receptor negative (ER−) breast cancer; Estrogen Receptor positive (ER+) breast cancer; Progesterone Receptor negative (PR−) breast cancer; Progesterone Receptor positive (PR+) breast cancer; ER positive (ER+) and PR positive (PR+) breast cancer; ER positive (ER+) and PR negative (PR−) breast cancer; ER negative (ER−) and PR positive (PR+) breast cancer; ER positive (ER+) and HER2 negative (HER2−) breast cancer; ER−, PR−, and HER2− triple negative breast cancer (ER−, PR−, HER2−; TNBC); hormone receptor negative breast cancer (ER− and PR−); ER+, PR+, and HER2+ triple positive breast cancer (ER+, PR+, HER2+; TPBC); hepatocellular carcinoma (HCC); head and neck squamous cell carcinoma (HNSCC); oral tongue squamous cell carcinoma (OTSCC); sarcomas (e.g. epitheloid, rhabdoid and synovial); esophageal cancer; gastric cancer; ovarian cancer; pancreatic cancer; lung cancer; non-small cell lung carcinoma (NSCLC); small-cell lung carcinoma (SCLC); squamous cell carcinoma (SCC); head and neck cancer; head and neck squamous cell carcinoma (HNSCC); gastrointestinal cancer; large intestinal cancer; small intestinal cancer; stomach cancer; colon cancer; colorectal cancer; bladder cancer; liver cancer; biliary tract cancer; urothelial cancer; endometrial cancer; cervical cancer; prostate cancer; mesothelioma; chordoma; renal cancer; renal cell carcinoma (RCC); brain cancer; neuroblastoma; glioblastoma; skin cancer; melanoma; basal cell carcinoma; merkel cell carcinoma; blood cancer; hematopoetic cancer; myeloma; multiple myeloma (MM); B cell malignancies; lymphoma; B cell lymphoma; Hodgkin lymphoma; T cell lymphoma; leukemia; or acute lymphocytic leukemia (ALL). In certain embodiments, the compound comprises an antisense compound targeted to MALAT1. In certain embodiments, the compound comprises an oligonucleotide targeted to MALAT1. In certain embodiments, the compound comprises a modified oligonucleotide consisting of 8 to 80 linked nucleosides and having a nucleobase sequence comprising at least 8 contiguous nucleobases of any of the nucleobase sequences of SEQ ID NOs: 2-10. In certain embodiments, the compound comprises a modified oligonucleotide consisting of 16 to 80 linked nucleosides and having a nucleobase sequence comprising the nucleobase sequence of any one of SEQ ID NOs: 2-10. In certain embodiments, the compound comprises a modified oligonucleotide consisting of the nucleobase sequence of any one of SEQ ID NOs: 2-10. In certain embodiments, a compound comprises a modified oligonucleotide consisting of 8 to 80 linked nucleosides and having a nucleobase sequence comprising at least 8 contiguous nucleobases of any of the nucleobase sequences of SEQ ID NOs: 36-2646 or 2664-2813. In certain embodiments, a compound comprises a modified oligonucleotide consisting of 16 to 80 linked nucleosides and having a nucleobase sequence comprising the nucleobase sequence of any one of SEQ ID NOs: 36-2646 or 2664-2813. In certain embodiments, a compound comprises a modified oligonucleotide consisting of the nucleobase sequence of any one of SEQ ID NOs: SEQ ID NOs: 36-2646 or 2664-2813. In any of the foregoing embodiments, the modified oligonucleotide can consist of 10 to 30 linked nucleosides. In certain embodiments, the compound is ION 1157034, 1157111, 1157190, 1157929, 1158161, 1158162, 1304884, 1304890, or 1304906. In any of the foregoing embodiments, the compound can be single-stranded or double-stranded. In any of the foregoing embodiments, the compound can be an antisense compound or oligomeric compound.

Certain embodiments are drawn to use of a compound comprising a MALAT1 specific inhibitor for the manufacture or preparation of a medicament for reducing or inhibiting cancer cell proliferation, cancer cell migration, cancer cell branching morphogenesis, tumor progression, tumor growth, or metastasis in an individual having cancer. Certain embodiments are drawn to use of a compound comprising a MALAT1 specific inhibitor for the manufacture or preparation of a medicament for increasing or inducing cancer cell differentiation, cancer cell adhesion, or tumor differentiation in an individual having cancer. In certain embodiments, administering the compound induces a breast cancer cell or breast tumor to have a cystic, ductular, or acinar phenotype or morphology. In certain embodiments, administering the compound induces a breast cancer cell or breast tumor to have a more differentiated phenotype or structure. In certain embodiments, the more differentiated phenotype or structure includes, but is not limited to, presence of secretory lipid droplets, increased desmosomal structures, polarized ductal structures, or increased levels of differentiation markers such as E-cadherin or milk proteins such as casein. In certain embodiments, the cancer is breast cancer; inflammatory breast cancer; breast ductal carcinoma; breast lobular carcinoma; luminal A breast cancer; luminal B breast cancer; basal-like breast cancer; HER2 positive (HER2+) breast cancer; HER2 negative (HER2-) breast cancer; Estrogen Receptor negative (ER-) breast cancer; Estrogen Receptor positive (ER+) breast cancer; Progesterone Receptor negative (PR-) breast cancer; Progesterone Receptor positive (PR+) breast cancer; ER positive (ER+) and PR positive (PR+) breast cancer; ER positive (ER+) and PR negative (PR-) breast cancer; ER negative (ER-) and PR positive (PR+) breast cancer; ER positive (ER+) and HER2 negative (HER2-) breast cancer; ER-, PR-, and HER2- triple negative breast cancer (ER-, PR-, HER2-; TNBC); hormone receptor negative breast cancer (ER- and PR-); ER+, PR+, and HER2+ triple positive breast cancer (ER+, PR+, HER2+; TPBC); hepatocellular carcinoma (HCC); head and neck squamous cell carcinoma (HNSCC); oral tongue squamous cell carcinoma (OTSCC); sarcomas (e.g. epitheloid, rhabdoid and synovial); esophageal cancer; gastric cancer; ovarian cancer; pancreatic cancer; lung cancer; non-small cell lung carcinoma (NSCLC); small-cell lung carcinoma (SCLC); squamous cell carcinoma (SCC); head and neck cancer; head and neck squamous cell carcinoma (HNSCC); gastrointestinal cancer; large intestinal cancer; small intestinal cancer; stomach cancer; colon cancer; colorectal cancer; bladder cancer; liver cancer; biliary tract cancer; urothelial cancer; endometrial cancer; cervical cancer; prostate cancer; mesothelioma; chordoma; renal cancer; renal cell carcinoma (RCC); brain cancer; neuroblastoma; glioblastoma; skin cancer; melanoma; basal cell carcinoma; merkel cell carcinoma; blood cancer; hematopoetic cancer; myeloma; multiple myeloma (MM); B cell malignancies; lymphoma; B cell lymphoma; Hodgkin lymphoma; T cell lymphoma; leukemia; or acute lymphocytic leukemia (ALL). In certain embodiments, the compound comprises an antisense compound targeted to MALAT1. In certain embodiments, the compound comprises an oligonucleotide targeted to MALAT1. In certain embodiments, the compound comprises a modified oligonucleotide consisting of 8 to 80 linked nucleosides and having a nucleobase sequence comprising at least 8 contiguous nucleobases of any of the nucleobase sequences of SEQ ID NOs: 2-10. In certain embodiments, the compound comprises a modified oligonucleotide consisting of 16 to 80 linked nucleosides and having a nucleobase sequence comprising the nucleobase sequence of any one of SEQ ID NOs: 2-10. In certain embodiments, the compound comprises a modified oligonucleotide consisting of the nucleobase sequence of any one of SEQ ID NOs: 2-10. In certain embodiments, a compound comprises a modified oligonucleotide consisting of 8 to 80 linked nucleosides and having a nucleobase sequence comprising at least 8 contiguous nucleobases of any of the nucleobase sequences of SEQ ID NOs: 36-2646 or 2664-2813. In certain embodiments, a compound comprises a modified oligonucleotide consisting of 16 to 80 linked nucleosides and having a nucleobase sequence comprising the nucleobase sequence of any one of SEQ ID NOs: 36-2646 or 2664-2813. In certain embodiments, a compound comprises a modified oligonucleotide consisting of the nucleobase sequence of any one of SEQ ID NOs: SEQ ID NOs: 36-2646 or 2664-2813. In any of the foregoing embodiments, the modified oligonucleotide can consist of 10 to 30 linked nucleosides. In certain embodiments, the compound is ION 1157034, 1157111, 1157190, 1157929, 1158161, 1158162, 1304884, 1304890, or 1304906. In any of the foregoing embodiments, the compound can be single-stranded or double-stranded. In any of the foregoing embodiments, the compound can be an antisense compound or oligomeric compound.

In any of the foregoing methods or uses, the compound can be targeted to MALAT1. In certain embodiments, the compound comprises or consists of a modified oligonucleotide, for example a modified oligonucleotide can consist of 8 to 80 linked nucleosides, 10 to 30 linked nucleosides, 12 to 30 linked nucleosides, or 20 linked nucleosides. In certain embodiments, the modified oligonucleotide is at least 80%, 85%, 90%, 95% or 100% complementary to SEQ ID NO: 1. In certain embodiments, the modified oligonucleotide comprises at least one modified internucleoside linkage, at least one modified sugar and/or at least one modified nucleobase. In certain embodiments, the modified internucleoside linkage is a phosphorothioate internucleoside linkage, the modified sugar is a bicyclic sugar or a 2'-O-methoxyethyl, and the modified nucleobase is a 5-methylcytosine. In certain embodiments, the modified oligonucleotide comprises a gap segment consisting of linked 2'-deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar.

In any of the foregoing embodiments, the modified oligonucleotide can consist of 12 to 30, 15 to 30, 15 to 25, 15 to 24, 16 to 24, 17 to 24, 18 to 24, 19 to 24, 20 to 24, 19 to 22, 20 to 22, 16 to 20, or 17 or 20 linked nucleosides. In certain embodiments, the modified oligonucleotide is at least 80%, 85%, 90%, 95% or 100% complementary to SEQ ID NO: 1. In certain embodiments, at least one internucleoside linkage of the modified oligonucleotide is a modified internucleoside linkage, at least one sugar of the modified oligonucleotide is a modified sugar and/or at least one nucleobase of the modified oligonucleotide is a modified nucleobase. In certain embodiments, the modified internucleoside linkage is a phosphorothioate internucleoside linkage, the modified sugar is a bicyclic sugar or a 2'-O-methoxyethyl sugar, and the modified nucleobase is 5-methylcytosine. In certain embodiments, the modified oligonucleotide has a gap segment consisting of linked 2'-deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar.

In any of the foregoing methods or uses, the compound can comprise or consist of a modified oligonucleotide having:
  a gap segment consisting of linked 2'-deoxynucleosides;
  a 5' wing segment consisting of linked nucleosides; and
  a 3' wing segment consisting of linked nucleosides;
  wherein the gap segment is positioned between the 5' wing segment and the 3' wing segment and wherein each nucleoside of each wing segment comprises a modified sugar. In certain embodiments, the modified oligonucleotide consists of 16 to 80 linked nucleosides and has a nucleobase sequence comprising the nucleobase sequence recited in any one of SEQ ID NOs: 2-10 or 36-2813. In certain embodiments, the modified oligonucleotide consists of 16 to 80 linked nucleosides and has a nucleobase sequence comprising the nucleobase sequence recited in any one of SEQ ID NOs: 2-10. In certain embodiments, the modified oligonucleotide consists of 16 to 30 linked nucleosides and has a nucleobase sequence comprising the nucleobase sequence recited in any one of SEQ ID NOs: 2-10 or 36-2813. In certain embodiments, the modified oligonucleotide consists of 16 to 30 linked nucleosides and has a nucleobase sequence comprising the nucleobase sequence recited in any one of SEQ ID NOs: 2-10. In certain embodiments, the modified oligonucleotide consists of 16 linked nucleosides and has a nucleobase sequence consisting of the nucleobase sequence recited in any one of SEQ ID NOs: 2-10 or 36-2813. In certain embodiments, the modified oligonucleotide consists of 16 linked nucleosides and has a nucleobase sequence consisting of the nucleobase sequence recited in any one of SEQ ID NOs: 2-10.

In any of the foregoing methods or uses, the compound can comprise or consist of a modified oligonucleotide consisting of 16 to 80 linked nucleobases and having a nucleobase sequence comprising the nucleobase sequence recited in any one of SEQ ID NOs: 2-10 or 36-2813, wherein the modified oligonucleotide has:
  a gap segment consisting of linked 2'-deoxynucleosides;
  a 5' wing segment consisting of linked nucleosides; and
  a 3' wing segment consisting of linked nucleosides;
  wherein the gap segment is positioned between the 5' wing segment and the 3' wing segment and wherein each nucleoside of each wing segment comprises a modified sugar. In certain embodiments, the modified oligonucleotide consists of 16 to 30 linked nucleosides. In certain embodiments, the modified oligonucleotide consists of 16 linked nucleosides.

In any of the foregoing methods or uses, the compound can comprise or consist of a modified oligonucleotide consisting of 16 to 80 linked nucleobases and having a nucleobase sequence comprising the nucleobase sequence recited in any one of SEQ ID NOs: 2-10, wherein the modified oligonucleotide has:
  a gap segment consisting of linked 2'-deoxynucleosides;
  a 5' wing segment consisting of linked nucleosides; and
  a 3' wing segment consisting of linked nucleosides;
  wherein the gap segment is positioned between the 5' wing segment and the 3' wing segment and wherein each nucleoside of each wing segment comprises a modified sugar. In certain embodiments, the modified oligonucleotide consists of 16 to 30 linked nucleosides. In certain embodiments, the modified oligonucleotide consists of 16 linked nucleosides.

In any of the foregoing methods or uses, the compound can comprise or consist of a modified oligonucleotide consisting of 16 to 80 linked nucleobases and having a nucleobase sequence comprising the nucleobase sequence recited in any one of SEQ ID NOs: 36-2646 or 2664-2813, wherein the modified oligonucleotide has:

a gap segment consisting of ten linked 2'-deoxynucleosides;

a 5' wing segment consisting of three linked nucleosides; and a 3' wing segment consisting of three linked nucleosides;

wherein the gap segment is positioned between the 5' wing segment and the 3' wing segment; wherein each nucleoside of each wing segment comprises a cEt nucleoside; wherein each internucleoside linkage is a phosphorothioate linkage; and wherein each cytosine is 5-methylcytosine. In certain embodiments, the modified oligonucleotide consists of 16 to 30 linked nucleosides. In certain embodiments, the modified oligonucleotide consists of 16 linked nucleosides.

In any of the foregoing methods or uses, the compound can comprise or consist of a modified oligonucleotide consisting of 16 to 80 linked nucleobases and having a nucleobase sequence comprising the nucleobase sequence recited in any one of SEQ ID NOs: 2-7, wherein the modified oligonucleotide has:

a gap segment consisting of ten linked 2'-deoxynucleosides;

a 5' wing segment consisting of three linked nucleosides; and a 3' wing segment consisting of three linked nucleosides;

wherein the gap segment is positioned between the 5' wing segment and the 3' wing segment; wherein each nucleoside of each wing segment comprises a cEt nucleoside; wherein each internucleoside linkage is a phosphorothioate linkage; and wherein each cytosine is 5-methylcytosine. In certain embodiments, the modified oligonucleotide consists of 16 to 30 linked nucleosides. In certain embodiments, the modified oligonucleotide consists of 16 linked nucleosides.

In any of the foregoing methods or uses, the compound can comprise or consist of a modified oligonucleotide having a nucleobase sequence comprising the nucleobase sequence recited in any of SEQ ID NOs: 8-10; wherein the modified oligonucleotide comprises the sugar motif kkk-d-y-d(8)-kkk, wherein "k" indicates a cEt modified sugar moiety, "d" indicates an unmodified 2'-deoxyribosyl sugar moiety, and "y" indicates a 2'-O-methyl modified sugar moiety; wherein each internucleoside linkage is a phosphorothioate linkage; and wherein each cytosine is 5-methylcytosine. In certain embodiments, the modified oligonucleotide consisting of 16 to 30 linked nucleosides. In certain embodiments, the modified oligonucleotide consists of 16 linked nucleosides.

In any of the foregoing methods or uses, the compound can comprise or consist of ION 1304884 having the nucleobase sequence and chemical motif: GksGksAksTdsUysAdsAdsTdsGdsTdsAdsGdsTdsGksTksAk (SEQ ID NO: 8), wherein "d" represents a 2'-deoxyribose sugar, "k" represents a cEt modified sugar, "y" represents a 2'-O-methyl modified sugar, "s" represents a phosphorothioate internucleoside linkage, and "mC" refers to 5-methylcytosine. In certain embodiments, the modified oligonucleotide consists of 16 to 30 linked nucleosides. In certain embodiments, the modified oligonucleotide consists of 16 linked nucleosides.

In any of the foregoing methods or uses, the compound can comprise or consist of ION 1304890 having the nucleobase sequence and chemical motif: GksGksTksTdsAysTdsAdsGdsmCdsTdsTdsGdsAdsmCksAksAk (SEQ ID NO: 9), wherein "d" represents a 2'-deoxyribose sugar, "k" represents a cEt modified sugar, "y" represents a 2'-O-methyl modified sugar, "s" represents a phosphorothioate internucleoside linkage, and "mC" refers to a 5-methylcytosine. In certain embodiments, the modified oligonucleotide consists of 16 to 30 linked nucleosides. In certain embodiments, the modified oligonucleotide consists of 16 linked nucleosides.

In any of the foregoing methods or uses, the compound can comprise or consist of ION 1304906 having the nucleobase sequence and chemical motif: GksmCksAksGdsAysTdsAdsAdsTdsGdsTdsTdsmCdsTksmCksAk (SEQ ID NO: 10), wherein "d" represents a 2'-deoxyribose sugar, "k" represents a cEt modified sugar, "y" represents a 2'-O-methyl modified sugar, "s" represents a phosphorothioate internucleoside linkage, and "mC" refers to 5-methylcytosine. In certain embodiments, the modified oligonucleotide consists of 16 to 30 linked nucleosides. In certain embodiments, the modified oligonucleotide consists of 16 linked nucleosides.

In any of the foregoing methods or uses, the compound can be a modified oligonucleotide according to the following chemical structure:

(SEQ ID NO: 6)

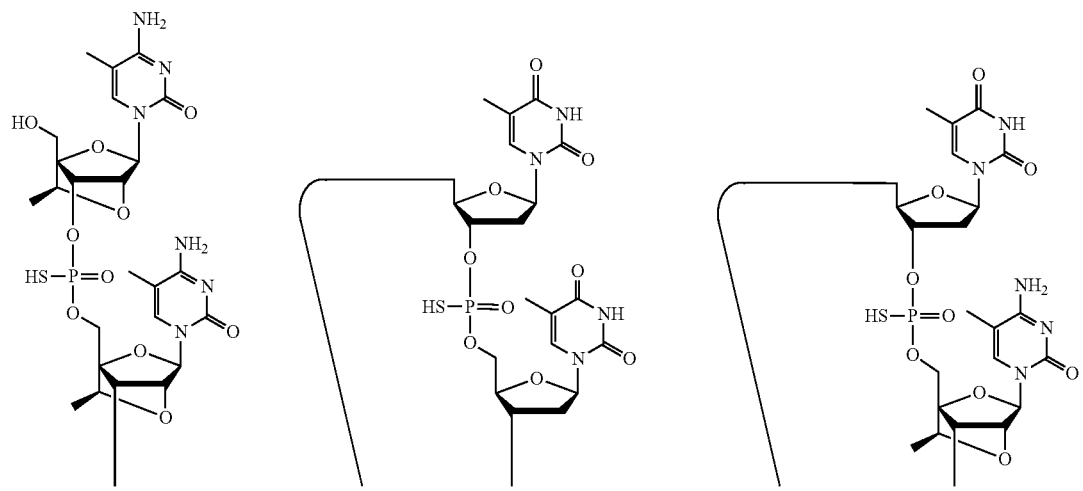

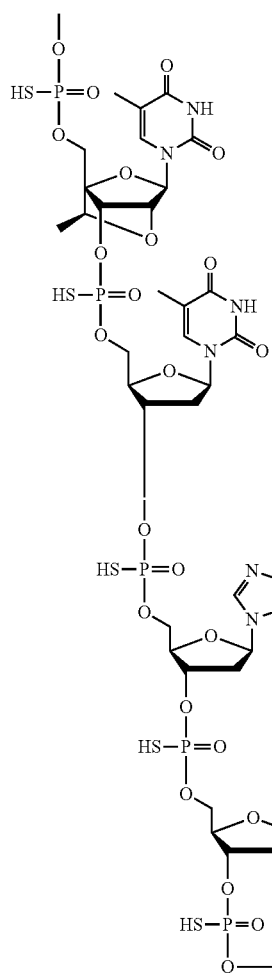
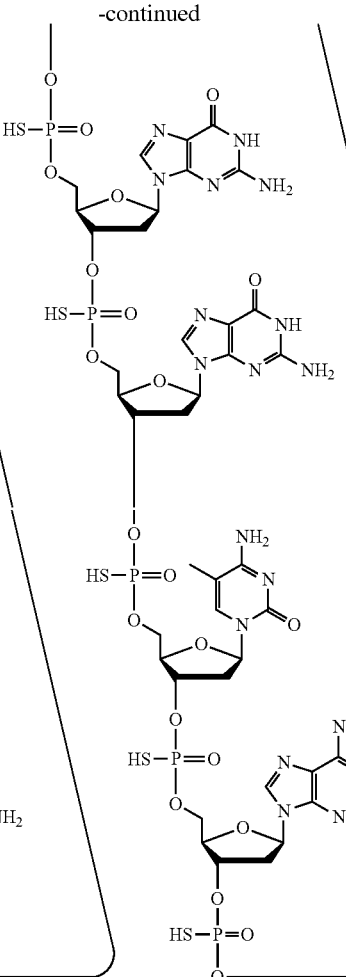
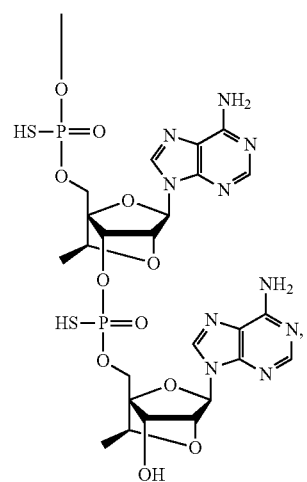
or a salt thereof. In certain embodiments, the modified oligonucleotide is the sodium salt or potassium salt.
In any of the foregoing methods or uses, the compound can be a modified oligonucleotide according to the following chemical structure:
(SEQ ID NO: 6)
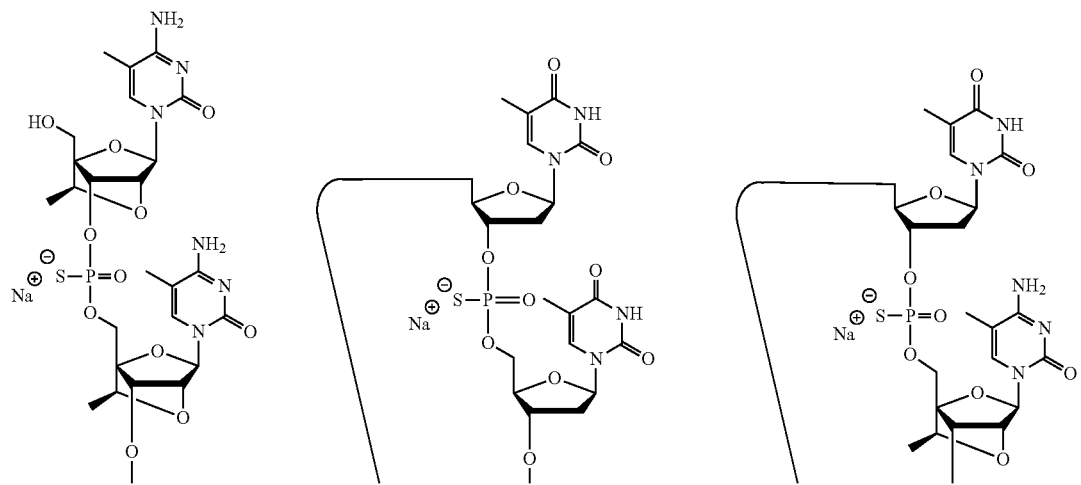

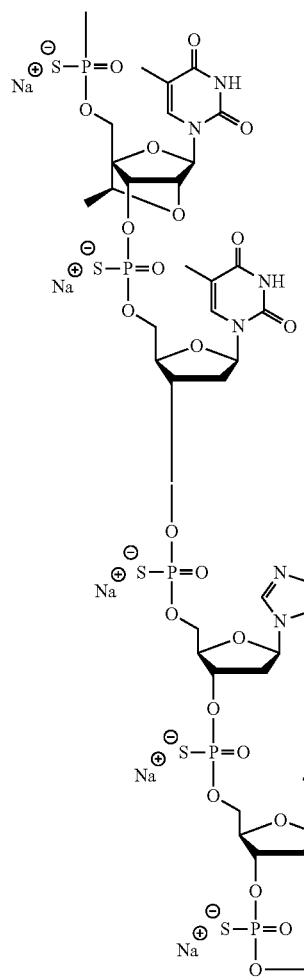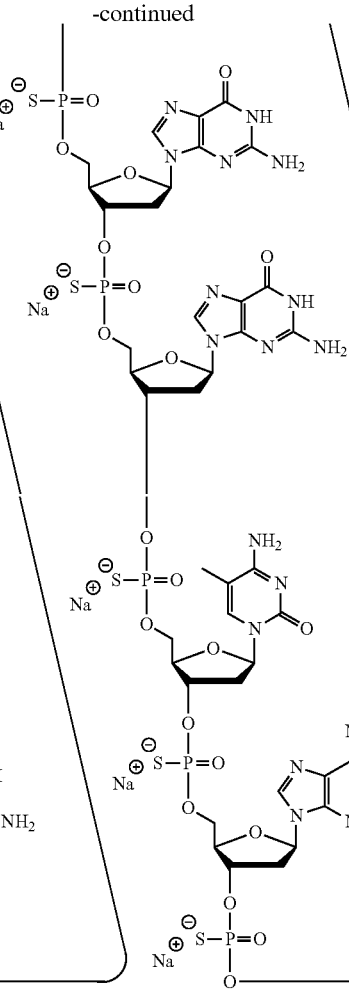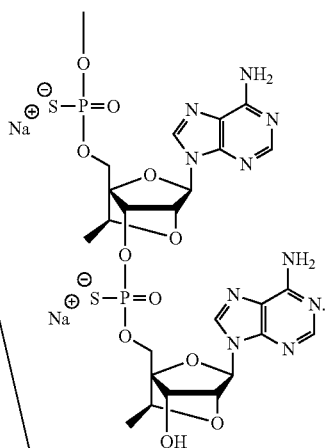

In any of the foregoing methods or uses, the compound can be administered parenterally. For example, in certain embodiments the compound can be administered through injection or infusion. Parenteral administration includes subcutaneous administration, intravenous administration, intramuscular administration, intraarterial administration, intraperitoneal administration, or intracranial administration, e.g. intrathecal or intracerebroventricular administration.

Certain Combinations and Combination Therapies

In certain embodiments, a first agent comprising a compound described herein is co-administered with one or more secondary agents. In certain embodiments, such second agents are designed to treat the same disease, disorder, or condition as the first agent described herein. In certain embodiments, such second agents are designed to treat a different disease, disorder, or condition as the first agent described herein. In certain embodiments, a first agent is designed to treat an undesired side effect of a second agent. In certain embodiments, second agents are co-administered with the first agent to treat an undesired effect of the first agent. In certain embodiments, such second agents are designed to treat an undesired side effect of one or more pharmaceutical compositions as described herein. In certain embodiments, second agents are co-administered with the first agent to produce a combinational effect. In certain embodiments, second agents are co-administered with the first agent to produce a synergistic effect. In certain embodiments, the co-administration of the first and second agents permits use of lower dosages than would be required to achieve a therapeutic or prophylactic effect if the agents were administered as independent therapy.

In certain embodiments, one or more compounds or compositions provided herein are co-administered with one or more secondary agents. In certain embodiments, one or more compounds or compositions provided herein and one or more secondary agents, are administered at different times. In certain embodiments, one or more compounds or compositions provided herein and one or more secondary agents, are prepared together in a single formulation. In certain embodiments, one or more compounds or compositions provided herein and one or more secondary agents, are prepared separately. In certain embodiments, a secondary agent is selected from: a chemotherapeutic agent including, but not limited to, capecitabine (Xeloda), carboplatin, cisplatin, cyclophosphamide, docetaxel (Taxotere), doxorubicin, epirubicin (Ellence), eribulin (Halaven), fluorouracil (5-FU, Efudex), gemcitabine (Gemzar), ixabepilone (Ixempra), methotrexate (Rheumatrex, Trexall), paclitaxel (Taxol), or vinorelbine (Navelbine); a combination regiment including, but not limited to, AC (doxorubicin and cyclophosphamide), EC (epirubicin, cyclophosphamide), AC or EC (epirubicin and cyclophosphamide) followed by T (doxorubicin and cyclophosphamide, followed by paclitaxel or docetaxel), CAF (cyclophosphamide, doxorubicin, and 5-FU), CEF (cyclophosphamide, epirubicin, and 5-FU), CMF (cyclophosphamide, methotrexate, and 5-FU), TAC (docetaxel, doxorubicin, and cyclophosphamide), TC (docetaxel and cyclophosphamide), AC-TH (doxorubicin, cyclophosphamide, paclitaxel, trastuzumab), AC-THP (doxorubicin, cyclophosphamide, paclitaxel, trastuzumab, pertuzumab), TCHP (docetaxel, carboplatin, trastuzumab, pertuzumab), TCH (docetaxel, carboplatin, trastuzumab), or TH (paclitaxel, trastuzumab); hormone therapy including, but not limited to, selective estrogen receptor modulators, tamoxifen, toremifene (Fareston), fulvestrant (Faslodex), goserelin (Zoladex), or leuprolide (Eligard, Lupron); aromatase inhibitors (AIs) including, but not limited to, anastrozole (Arimidex), exemestane (Aromasin), or letrozole (Femara); HER2-targeted therapy including, but not limited to, trastuzumab (Herceptin), lapatinib (TYKERB), pertuzumab (Perjeta), or neratinib (Nerlynx).

Certain embodiments are directed to the use of a compound targeted to MALAT1 as described herein in combination with a secondary agent. In particular embodiments such use is in a method of treating a patient suffering from cancer including, but not limited to, breast cancer; inflammatory breast cancer; breast ductal carcinoma; breast lobular carcinoma; luminal A breast cancer; luminal B breast cancer; basal-like breast cancer; HER2 positive (HER2+) breast cancer; HER2 negative (HER2−) breast cancer; Estrogen Receptor negative (ER−) breast cancer; Estrogen Receptor positive (ER+) breast cancer; Progesterone Receptor negative (PR−) breast cancer; Progesterone Receptor positive (PR+) breast cancer; ER positive (ER+) and PR positive (PR+) breast cancer; ER positive (ER+) and PR negative (PR−) breast cancer; ER negative (ER−) and PR positive (PR+) breast cancer; ER positive (ER+) and HER2 negative (HER2−) breast cancer; ER−, PR−, and HER2− triple negative breast cancer (ER−, PR−, HER2−; TNBC); hormone receptor negative breast cancer (ER− and PR−); ER+, PR+, and HER2+ triple positive breast cancer (ER+, PR+, HER2+; TPBC); hepatocellular carcinoma (HCC); head and neck squamous cell carcinoma (HNSCC); oral tongue squamous cell carcinoma (OTSCC); sarcomas (e.g. epithelioid, rhabdoid and synovial); esophageal cancer; gastric cancer; ovarian cancer; pancreatic cancer; lung cancer; non-small cell lung carcinoma (NSCLC); small-cell lung carcinoma (SCLC); squamous cell carcinoma (SCC); head and neck cancer; head and neck squamous cell carcinoma (HNSCC); gastrointestinal cancer; large intestinal cancer; small intestinal cancer; stomach cancer; colon cancer; colorectal cancer; bladder cancer; liver cancer; biliary tract cancer; urothelial cancer; endometrial cancer; cervical cancer; prostate cancer; mesothelioma; chordoma; renal cancer; renal cell carcinoma (RCC); brain cancer; neuroblastoma; glioblastoma; skin cancer; melanoma; basal cell carcinoma; merkel cell carcinoma; blood cancer; hematopoetic cancer; myeloma; multiple myeloma (MM); B cell malignancies; lymphoma; B cell lymphoma; Hodgkin lymphoma; T cell lymphoma; leukemia; or acute lymphocytic leukemia (ALL). In certain embodiments, a secondary agent is selected from: a chemotherapeutic agent including, but not limited to, capecitabine (Xeloda), carboplatin, cisplatin, cyclophosphamide, docetaxel (Taxotere), doxorubicin, epirubicin (Ellence), eribulin (Halaven), fluorouracil (5-FU, Efudex), gemcitabine (Gemzar), ixabepilone (Ixempra), methotrexate (Rheumatrex, Trexall), paclitaxel (Taxol), or vinorelbine (Navelbine); a combination regiment including, but not limited to, AC (doxorubicin and cyclophosphamide), EC (epirubicin, cyclophosphamide), AC or EC (epirubicin and cyclophosphamide) followed by T (doxorubicin and cyclophosphamide, followed by paclitaxel or docetaxel), CAF (cyclophosphamide, doxorubicin, and 5-FU), CEF (cyclophosphamide, epirubicin, and 5-FU), CMF (cyclophosphamide, methotrexate, and 5-FU), TAC (docetaxel, doxorubicin, and cyclophosphamide), TC (docetaxel and cyclophosphamide), AC-TH (doxorubicin, cyclophosphamide, paclitaxel, trastuzumab), AC-THP (doxorubicin, cyclophosphamide, paclitaxel, trastuzumab, pertuzumab), TCHP (docetaxel, carboplatin, trastuzumab, pertuzumab), TCH (docetaxel, carboplatin, trastuzumab), or TH (paclitaxel, trastuzumab); hormone therapy including, but not limited to, selective estrogen receptor modulators, tamoxifen, toremifene (Fareston), fulvestrant (Faslodex), goserelin (Zoladex), or leuprolide (Eligard, Lupron); aromatase inhibitors (AIs) including, but not limited to, anastrozole (Arimidex), exemestane (Aromasin), or letrozole (Femara); HER2-targeted therapy including, but not limited to, trastuzumab (Herceptin), lapatinib (TYKERB), pertuzumab (Perjeta), or neratinib (Nerlynx).

Certain embodiments are drawn to a combination of a compound targeted to MALAT1 as described herein and a secondary agent, such as a secondary agent selected from: a chemotherapeutic agent including, but not limited to, capecitabine (Xeloda), carboplatin, cisplatin, cyclophosphamide, docetaxel (Taxotere), doxorubicin, epirubicin (Ellence), eribulin (Halaven), fluorouracil (5-FU, Efudex), gemcitabine (Gemzar), ixabepilone (Ixempra), methotrexate (Rheumatrex, Trexall), paclitaxel (Taxol), or vinorelbine (Navelbine); a combination regiment including, but not limited to, AC (doxorubicin and cyclophosphamide), EC (epirubicin, cyclophosphamide), AC or EC (epirubicin and cyclophosphamide) followed by T (doxorubicin and cyclophosphamide, followed by paclitaxel or docetaxel), CAF (cyclophosphamide, doxorubicin, and 5-FU), CEF (cyclophosphamide, epirubicin, and 5-FU), CMF (cyclophosphamide, methotrexate, and 5-FU), TAC (docetaxel, doxorubicin, and cyclophosphamide), TC (docetaxel and cyclophosphamide), AC-TH (doxorubicin, cyclophosphamide, paclitaxel, trastuzumab), AC-THP (doxorubicin, cyclophosphamide, paclitaxel, trastuzumab, pertuzumab), TCHP (docetaxel, carboplatin, trastuzumab, pertuzumab), TCH (docetaxel, carboplatin, trastuzumab), or TH (paclitaxel, trastuzumab); hormone therapy including, but not limited to, selective estrogen receptor modulators, tamoxifen, toremifene (Fareston), fulvestrant (Faslodex), goserelin (Zoladex), or leuprolide (Eligard, Lupron); aromatase inhibitors (AIs) including, but not limited to, anastrozole (Arimidex), exemestane (Aromasin), or letrozole (Femara); HER2-targeted therapy including, but not limited to, trastuzumab (Herceptin), lapatinib (TYKERB), pertuzumab (Perjeta), or neratinib (Nerlynx).

In certain embodiments the compound targeted to MALAT1 as described herein and the secondary agent are used in combination treatment by administering the two agents simultaneously, separately or sequentially. In certain embodiments the two agents are formulated as a fixed dose combination product. In other embodiments the two agents are provided to the patient as separate units which can then either be taken simultaneously or serially (sequentially).

In certain embodiments, a compound targeted to MALAT1 as described herein is used in combination with an immunomodulatory agent such as an anti-PD-L1 antibody (or an antigen-binding fragment thereof), an anti-PD-1 antibody (or an antigen-binding fragment thereof), an anti-CTLA-4 antibody (or an antigen-binding fragment thereof)

or an OX40 agonist ((e.g., an OX40 ligand fusion protein, or an OX40 agonist antibody or antigen-binding fragment thereof).

In certain embodiments, a compound targeted to MALAT1 as described herein is used in combination with an immune checkpoint inhibitor such as an anti-PD-L1 antibody (or an antigen-binding fragment thereof), an anti-PD-1 antibody (or an antigen-binding fragment thereof), or an anti-CTLA-4 antibody (or an antigen-binding fragment thereof).

Anti-PD-L1 antibodies are known in the art. Exemplary anti-PD-L1 antibodies include: MEDI4736 (durvalumab), MPDL3280A, BMS936559, 2.7A4, AMP-714, MDX-1105 and MPDL3280A (atezolizumab).

Anti-PD-1 antibodies are known in the art. Exemplary anti-PD-1 antibodies include: nivolumab, pembrolizumab, pidilizumab, and AMP-514 Anti-CTLA-4 antibodies are known in the art. Exemplary anti-CTLA-4 antibodies include: tremelimumab and ipilimumab, also termed MDX-010 (or BMS-734016).

OX40 agonists and antibodies are known in the art. Exemplary OX40 agonists and/or antibodies include: MEDI6383, 9B12 and MEDI0562.

In one embodiment, the combination includes the antisense oligonucleotide Ionis 1158161 or a salt thereof, and at least one immunomodulator selected from the group consisting of: MEDI4736, MPDL3280A, BMS936559, 2.7A4, AMP-714, MDX-1105, nivolumab, pembrolizumab, pidilizumab, MPDL3280A, tremelimumab, ipilimumab, MEDI0562 and MEDI0562.

Certain Anti-PD-L1 Antibodies

Antibodies that specifically bind and inhibit PD-L1 are included in the present disclosure.

Durvalumab (MEDI4736) is an exemplary anti-PD-L1 antibody that is selective for a PD-L1 polypeptide and blocks the binding of PD-L1 to the PD-1 and CD80 receptors. Durvalumab can relieve PD-L1-mediated suppression of human T-cell activation in vitro and inhibits tumor growth in a xenograft model via a T-cell dependent mechanism.

Information regarding durvalumab (or fragments thereof) for use in the methods provided herein can be found in U.S. Pat. No. 8,779,108, the disclosure of which is incorporated herein by reference in its entirety. The fragment crystallizable (Fc) domain of durvalumab contains a triple mutation in the constant domain of the IgG1 heavy chain that reduces binding to the complement component C1q and the Fcγ receptors responsible for mediating antibody-dependent cell-mediated cytotoxicity (ADCC).

Durvalumab and antigen-binding fragments thereof for use in the methods provided herein comprises a heavy chain and a light chain or a heavy chain variable region and a light chain variable region. In certain embodiments, MEDI4736 or an antigen-binding fragment thereof for use in the methods provided herein comprises the variable heavy chain and variable light chain CDR sequences of the 2.14H9OPT antibody as disclosed in U.S. Pat. Nos. 8,779,108 and 9,493,565, which is herein incorporated by reference in its entirety. There are numerous anti-PD-L1 antibodies in the published literature that could feature in the present disclosure, including compounds in development and/or in clinical trials such as: durvalumab (MEDI4736), MPDL3280A, BMS936559, 2.7A4, AMP-714 and MDX-1105. Patent specifications disclosing anti-PD-L1 antibodies that may be useful in the present disclosure include: U.S. Pat. Nos. 7,943,743; 8,383,796; 9,102,725; 9,273,135 (BMS/Medarex), US2006/153841 (Dana Farber), US2011/0271358 (Dana Farber), U.S. Pat. Nos. 8,552,154 and 9,102,727 (Dana Farber), U.S. Pat. No. 8,217,149 (Genentech), including issued U.S. Pat. No. 8,217,149, US2012/0039906 (INSERM), US2016/0031990 (Amplimmune), U.S. Pat. No. 8,779,108 (MedImmune—for durvalumab/MEDI4726 and 2.7A4), US2014/0044738 (Amplimmune—for AMP-714) and US2010/0285039 (John's Hopkins University). Each of these disclosures is herein incorporated by reference in its entirety.

Certain Anti-CTLA-4 Antibodies

Antibodies that specifically bind CTLA-4 and inhibit CTLA-4 activity are useful for enhancing an anti-tumor immune response. Information regarding tremelimumab (or antigen-binding fragments thereof) for use in the methods provided herein can be found in U.S. Pat. No. 6,682,736 (where it is referred to as 11.2.1), the disclosure of which is incorporated herein by reference in its entirety. Tremelimumab (also known as CP-675,206, CP-675, CP-675206, and ticilimumab) is a human IgG2 monoclonal antibody that is highly selective for CTLA-4 and blocks binding of CTLA-4 to CD80 (B7.1) and CD86 (B7.2). It has been shown to result in immune activation in vitro and some patients treated with tremelimumab have shown tumor regression.

Tremelimumab for use in the methods provided herein comprises a heavy chain and a light chain or a heavy chain variable region and a light chain variable region. In a specific aspect, tremelimumab or an antigen-binding fragment thereof for use in the methods provided herein comprises a light chain variable region comprising the amino acid sequences shown herein above and a heavy chain variable region comprising the amino acid sequence shown herein above. In a specific aspect, tremelimumab or an antigen-binding fragment thereof for use in the methods provided herein comprises a heavy chain variable region and a light chain variable region, wherein the heavy chain variable region comprises the Kabat-defined CDR1, CDR2, and CDR3 sequences shown herein above, and wherein the light chain variable region comprises the Kabat-defined CDR1, CDR2, and CDR3 sequences shown herein above. Those of ordinary skill in the art would easily be able to identify Chothia-defined, Abm-defined or other CDR definitions known to those of ordinary skill in the art. In a specific aspect, tremelimumab or an antigen-binding fragment thereof for use in the methods provided herein comprises the variable heavy chain and variable light chain CDR sequences of the 11.2.1 antibody as disclosed in U.S. Pat. No. 6,682,736, which is herein incorporated by reference in its entirety.

Other anti-CTLA-4 antibodies are described, for example, in US 20070243184. In one embodiment, the anti-CTLA-4 antibody is Ipilimumab, also termed MDX-010; BMS-734016.

Certain OX40 Agonists

OX40 agonists interact with the OX40 receptor on CD4+ T-cells during, or shortly after, priming by an antigen resulting in an increased response of the CD4+ T-cells to the antigen. An OX40 agonist interacting with the OX40 receptor on antigen specific CD4+ T-cells can increase T cell proliferation as compared to the response to antigen alone. The elevated response to the antigen can be maintained for a period of time substantially longer than in the absence of an OX40 agonist. Thus, stimulation via an OX40 agonist enhances the antigen specific immune response by boosting T-cell recognition of antigens, e.g., tumor cells. OX40 agonists are described, for example, in U.S. Pat. Nos. 6,312,700, 7,504,101, 7,622,444, and 7,959,925, which are incorporated herein by reference in their entireties. Methods of using such agonists in cancer treatment are described, for example, in US2015/0098942 and in US2015/0157710, each of which are incorporated herein by reference in its entirety.

OX40 agonists include, but are not limited to OX40 binding molecules, e.g., binding polypeptides, e.g., OX40 ligand ("OX40L") or an OX40-binding fragment, variant, or derivative thereof, such as soluble extracellular ligand domains and OX40L fusion proteins, and anti-OX40 antibodies (for example, monoclonal antibodies such as humanized monoclonal antibodies), or an antigen-binding fragment, variant or derivative thereof. Examples of anti-OX40 monoclonal antibodies are described, for example, in U.S. Pat. Nos. 5,821,332 and 6,156,878, the disclosures of which are incorporated herein by reference in their entireties. In certain embodiments, the anti-OX40 monoclonal antibody is 9B12, or an antigen-binding fragment, variant, or derivative thereof, as described in Weinberg, A. D., et al. J Immunother 29, 575-585 (2006), which is incorporated herein by reference in its entirety. In another embodiment, an OX40 antibody is MEDI0562 as described in US 2016/0137740.

In certain embodiments, the antibody which specifically binds to OX40, or an antigen-binding fragment thereof binds to the same OX40 epitope as mAb 9B12. An example of a humanized OX40 antibody is described by Morris et al., Mol Immunol. May 2007; 44(12): 3112-3121. 9B12 is a murine IgG1, anti-OX40 mAb directed against the extracellular domain of human OX40 (CD134) (Weinberg, A. D., et al. J Immunother 29, 575-585 (2006)). It was selected from a panel of anti-OX40 monoclonal antibodies because of its ability to elicit an agonist response for OX40 signaling, stability, and for its high level of production by the hybridoma. For use in clinical applications, 9B12 mAb is equilibrated with phosphate buffered saline, pH 7.0, and its concentration is adjusted to 5.0 mg/ml by diafiltration.

"OX40 ligand" ("OX40L") (also variously termed tumor necrosis factor ligand superfamily member 4, gp34, TAX transcriptionally-activated glycoprotein-1, and CD252) is found largely on antigen presenting cells (APCs), and can be induced on activated B cells, dendritic cells (DCs), Langerhans cells, plamacytoid DCs, and macrophages (Croft, M., (2010) Ann Rev Immunol 28:57-78). Other cells, including activated T cells, NK cells, mast cells, endothelial cells, and smooth muscle cells can express OX40L in response to inflammatory cytokines (Id.). OX40L specifically binds to the OX40 receptor. The human protein is described in U.S. Pat. No. 6,156,878. The mouse OX40L is described in U.S. Pat. No. 5,457,035. OX40L is expressed on the surface of cells and includes an intracellular, a transmembrane and an extracellular receptor-binding domain. A functionally active soluble form of OX40L can be produced by deleting the intracellular and transmembrane domains as described, e.g., in U.S. Pat. Nos. 5,457,035; 6,312,700; 6,156,878; 6,242,566; 6,528,055; 6,528,623; 7,098,184; and 7,125,670, the disclosures of which are incorporated herein for all purposes. A functionally active form of OX40L is a form that retains the capacity to bind specifically to OX40, that is, that possesses an OX40 "receptor binding domain." An example is amino acids 51 to 183 of human OX40L. Methods of determining the ability of an OX40L molecule or derivative to bind specifically to OX40 are discussed below. Methods of making and using OX40L and its derivatives (such as derivatives that include an OX40 binding domain) are described in U.S. Pat. Nos. 6,156,878; 6,242,566; 6,528,055; 6,528,623; 7,098,184; and 7,125,670, which also describe proteins comprising the soluble form of OX40L linked to other peptides, such as human immunoglobulin ("Ig") Fc regions, that can be produced to facilitate purification of OX40 ligand from cultured cells, or to enhance the stability of the molecule after in vivo administration to a mammal (see also, U.S. Pat. Nos. 5,457,035 and 7,959,925, both of which are incorporated by reference herein in their entireties).

Also included within the definition of OX40L are OX40 ligand variants which vary in amino acid sequence from naturally occurring OX40 ligand molecules but which retain the ability to specifically bind to an OX40 receptor. Such variants are described in U.S. Pat. Nos. 5,457,035; 6,156,878; 6,242,566; 6,528,055; 6,528,623; 7,098,184; and 7,125,670. In a related embodiment, a mutant of OX40L which has lost the ability to specifically bind to OX40, for example amino acids 51 to 183, in which the phenylalanine at position 180 of the receptor-binding domain of human OX40L has been replaced with alanine (F180A) is used.

OX40 agonists include a fusion protein in which one or more domains of OX40L is covalently linked to one or more additional protein domains. Exemplary OX40L fusion proteins that can be used as OX40 agonists are described in U.S. Pat. No. 6,312,700, the disclosure of which is incorporated herein by reference in its entirety. In one embodiment, an OX40 agonist includes an OX40L fusion polypeptide that self-assembles into a multimeric (e.g., trimeric or hexameric) OX40L fusion protein. Such fusion proteins are described, e.g., in U.S. Pat. No. 7,959,925, which is incorporated by reference herein in its entirety. The multimeric OX40L fusion protein exhibits increased efficacy in enhancing antigen specific immune response in a subject, particularly a human subject, due to its ability to spontaneously assemble into highly stable trimers and hexamers.

In another embodiment, an OX40 agonist capable of assembling into a multimeric form includes a fusion polypeptide comprising in an N-terminal to C-terminal direction: an immunoglobulin domain, wherein the immunoglobulin domain includes an Fc domain, a trimerization domain, wherein the trimerization domain includes a coiled coil trimerization domain, and a receptor binding domain, wherein the receptor binding domain is an OX40 receptor binding domain, e.g., an OX40L or an OX40-binding fragment, variant, or derivative thereof, where the fusion polypeptide can self-assemble into a trimeric fusion protein. In one aspect, an OX40 agonist capable of assembling into a multimeric form is capable of binding to the OX40 receptor and stimulating at least one OX40 mediated activity. In certain aspects, the OX40 agonist includes an extracellular domain of OX40 ligand.

The trimerization domain of an OX40 agonist capable of assembling into a multimeric form serves to promote self-assembly of individual OX40L fusion polypeptide molecules into a trimeric protein. Thus, an OX40L fusion polypeptide with a trimerization domain self-assembles into a trimeric OX40L fusion protein. In one aspect, the trimerization domain is an isoleucine zipper domain or other coiled coli polypeptide structure. Exemplary coiled coil trimerization domains include: TRAF2 (GENBANK® Accession No. Q12933, amino acids 299-348; Thrombospondin 1 (Accession No. P07996, amino acids 291-314; Matrilin-4 (Accession No. O95460, amino acids 594-618; CMP (matrilin-1) (Accession No. NP-002370, amino acids 463-496; HSF1 (Accession No. AAX42211, amino acids 165-191; and Cubilin (Accession No. NP-001072, amino acids 104-138. In certain specific aspects, the trimerization domain includes a TRAF2 trimerization domain, a Matrilin-4 trimerization domain, or a combination thereof.

OX40L FP is a human OX40 ligand IgG4P fusion protein that specifically binds to, and triggers signaling by, the human OX40 receptor, a member of the TNFR superfamily. OX40L FP is also disclosed in US2016/0024176, incorporated herein by reference in its entirety. OX40L FP is composed of three distinct domains: (1) human OX40 ligand extracellular receptor binding domains (RBDs) that form homotrimers and bind the OX40 receptor; (2) isoleucine zipper trimerization domains derived from TNFR-associated factor 2 that stabilize the homotrimeric structure of the OX40 ligand RBDs; and (3) human IgG4 fragment crystallizable gamma (Fcγ) domains that facilitate Fcγ receptor clustering of the fusion protein when bound to OX40 receptors, and contain a serine to proline substitution at position 228 (according to EU numbering) in the hinge regions (IgG4P) to promote stability of two sets of OX40 ligand RBD homotrimers. The IgG4P Fc domain is fused directly to an isoleucine zipper trimerization domain derived from amino acid residues 310-349 of human tumor necrosis factor 2 (TRAF2). Fused to the c-terminus of the TRAF2 domain are amino acid residues 51-183 of the extracellular receptor binding domain (RBD) of human OX40L (gene name TNFSF4). The TRAF2 domain stabilizes the homotrimeric structure of OX40L RBDs to enable OX40 binding and activation, while the IgG4P Fc domain confers serum stability, dimerization of OX40L trimers, and facilitates Fcγ receptor clustering of the hexameric fusion protein. One OX40L FP variant possesses a phenylalanine (F) to alanine (A) mutation at the amino acid corresponding to position 180 in OX40L. Another OX40L FP variant has the IgG4P Fc domain replaced with a human IgG1 Fc domain. In particular embodiments, the OX40 agonist for use in the present disclosure is one of the OX40L FP variants.

In particular embodiments, the OX40 agonist for use in the present disclosure has been modified to increase its serum half-life. For example, the serum half-life of an OX40 agonist can be increased by conjugation to a heterologous molecule such as serum albumin, an antibody Fc region, or PEG. In certain embodiments, OX40 agonists can be conjugated to other therapeutic agents or toxins to form immunoconjugates and/or fusion proteins. In certain embodiments, the OX40 agonist can be formulated so as to facilitate administration and promote stability of the active agent.

Antibody Derivatives

Antibodies for use in the present disclosure (e.g., anti-CTLA-4, anti-PD-L1, anti-PD-1, anti-OX40) may include variants of these sequences that retain the ability to specifically bind their targets. Such variants may be derived from the sequence of these antibodies by a skilled artisan using techniques well known in the art. For example, amino acid substitutions, deletions, or additions, can be made in the FRs and/or in the CDRs. While changes in the FRs are usually designed to improve stability and immunogenicity of the antibody, changes in the CDRs are typically designed to increase affinity of the antibody for its target. Variants of FRs also include naturally occurring immunoglobulin allotypes. Such affinity-increasing changes may be determined empirically by routine techniques that involve altering the CDR and testing the affinity antibody for its target. For example, conservative amino acid substitutions can be made within any one of the disclosed CDRs. Various alterations can be made according to the methods described in Antibody Engineering, 2nd ed., Oxford University Press, ed. Borrebaeck, 1995. These include but are not limited to nucleotide sequences that are altered by the substitution of different codons that encode a functionally equivalent amino acid residue within the sequence, thus producing a "silent" change. For example, the nonpolar amino acids include alanine, leucine, isoleucine, valine, proline, phenylalanine, tryptophan, and methionine. The polar neutral amino acids include glycine, serine, threonine, cysteine, tyrosine, asparagine, and glutamine. The positively charged (basic) amino acids include arginine, lysine, and histidine. The negatively charged (acidic) amino acids include aspartic acid and glutamic acid.

Derivatives and analogs of antibodies of the present disclosure can be produced by various techniques well known in the art, including recombinant and synthetic methods (Maniatis (1990) Molecular Cloning, A Laboratory Manual, 2nd ed., Cold Spring Harbor Laboratory, Cold Spring Harbor, N.Y., and Bodansky et al. (1995) The Practice of Peptide Synthesis, 2nd ed., Spring Verlag, Berlin, Germany). Analogous shuffling or combinatorial techniques are also disclosed by Stemmer (Nature (1994) 370: 389-391), who describes the technique in relation to a β-lactamase gene but observes that the approach may be used for the generation of antibodies.

One may generate novel VH or VL regions carrying one or more sequences derived from the sequences disclosed herein using random mutagenesis of one or more selected VH and/or VL genes. One such technique, error-prone PCR, is described by Gram et al. (Proc. Nat. Acad. Sci. U.S.A. (1992) 89: 3576-3580).

Another method that may be used is to direct mutagenesis to CDRs of VH or VL genes. Such techniques are disclosed by Barbas et al. (Proc. Nat. Acad. Sci. U.S.A. (1994) 91: 3809-3813) and Schier et al. (J. Mol. Biol. (1996) 263: 551-567).

Similarly, one or more, or all three CDRs may be grafted into a repertoire of VH or VL domains, which are then screened for an antigen-binding fragment specific for CTLA-4 or PD-L1.

A portion of an immunoglobulin variable domain will comprise at least one of the CDRs substantially as set out herein and, optionally, intervening framework regions from the scFv fragments as set out herein. The portion may include at least about 50% of either or both of FR1 and FR4, the 50% being the C-terminal 50% of FR1 and the N-terminal 50% of FR4. Additional residues at the N-terminal or C-terminal end of the substantial part of the variable domain may be those not normally associated with naturally occurring variable domain regions. For example, construction of antibodies by recombinant DNA techniques may result in the introduction of N- or C-terminal residues encoded by linkers introduced to facilitate cloning or other manipulation steps. Other manipulation steps include the introduction of linkers to join variable domains to further protein sequences including immunoglobulin heavy chain constant regions, other variable domains (for example, in the production of diabodies), or proteinaceous labels as discussed in further detail below.

A skilled artisan will recognize that antibodies for use in the present disclosure may comprise antigen-binding fragments containing only a single CDR from either VL or VH domain. Either one of the single chain specific binding domains can be used to screen for complementary domains capable of forming a two-domain specific antigen-binding fragment capable of, for example, binding to CTLA-4 and PD-L1.

Antibodies for use in the present disclosure described herein can be linked to another functional molecule, e.g., another peptide or protein (albumin, another antibody, etc.). For example, the antibodies can be linked by chemical cross-linking or by recombinant methods. The antibodies may also be linked to one of a variety of nonproteinaceous polymers, e.g., polyethylene glycol, polypropylene glycol, or polyoxyalkylenes, in the manner set forth in U.S. Pat. Nos. 4,640,835; 4,496,689; 4,301,144; 4,670,417; 4,791,192; or 4,179,337. The antibodies can be chemically modified by covalent conjugation to a polymer, for example, to increase their circulating half-life. Exemplary polymers and methods to attach them are also shown in U.S. Pat. Nos. 4,766,106; 4,179,337; 4,495,285, and 4,609,546.

The antibodies may also be altered to have a glycosylation pattern that differs from the native pattern. For example, one or more carbohydrate moieties can be deleted and/or one or more glycosylation sites added to the original antibody. Addition of glycosylation sites to the presently disclosed antibodies may be accomplished by altering the amino acid sequence to contain glycosylation site consensus sequences known in the art. Another means of increasing the number of carbohydrate moieties on the antibodies is by chemical or enzymatic coupling of glycosides to the amino acid residues of the antibody. Such methods are described in WO 87/05330, and in Aplin et al. (1981) CRC Crit. Rev. Biochem., 22: 259-306. Removal of any carbohydrate moieties from the antibodies may be accomplished chemically or enzymatically, for example, as described by Hakimuddin et al. (1987) Arch. Biochem. Biophys., 259: 52; and Edge et al. (1981) Anal. Biochem., 118: 131 and by Thotakura et al. (1987) Meth. Enzymol., 138: 350. The antibodies may also be tagged with a detectable, or functional, label. Detectable labels include radiolabels such as 131I or 99Tc, which may also be attached to antibodies using conventional chemistry. Detectable labels also include enzyme labels such as horseradish peroxidase or alkaline phosphatase. Detectable labels further include chemical moieties such as biotin, which may be detected via binding to a specific cognate detectable moiety, e.g., labeled avidin.

Antibodies, in which CDR sequences differ only insubstantially from those set forth herein are encompassed within the scope of this present disclosure. Typically, an amino acid is substituted by a related amino acid having similar charge, hydrophobic, or stereochemical characteristics. Such substitutions would be within the ordinary skills of an artisan. Unlike in CDRs, more substantial changes can be made in FRs without adversely affecting the binding properties of an antibody. Changes to FRs include, but are not limited to, humanizing a non-human derived or engineering certain framework residues that are important for antigen contact or for stabilizing the binding site, e.g., changing the class or subclass of the constant region, changing specific amino acid residues which might alter the effector function such as Fc receptor binding, e.g., as described in U.S. Pat. Nos. 5,624,821 and 5,648,260 and Lund et al. (1991) J. Immun. 147: 2657-2662 and Morgan et al. (1995) Immunology 86: 319-324, or changing the species from which the constant region is derived.

One of skill in the art will appreciate that the modifications described above are not all-exhaustive, and that many other modifications would be obvious to a skilled artisan in light of the teachings of the present disclosure.

Certain Compounds

In certain embodiments, compounds described herein can be antisense compounds. In certain embodiments, the antisense compound comprises or consists of an oligomeric compound. In certain embodiments, the oligomeric compound comprises a modified oligonucleotide. In certain embodiments, the modified oligonucleotide has a nucleobase sequence complementary to that of a target nucleic acid. In certain embodiments, a compound described herein comprises or consists of a modified oligonucleotide. In certain embodiments, the modified oligonucleotide has a nucleobase sequence complementary to that of a target nucleic acid.

In certain embodiments, a compound or antisense compound is single-stranded. Such a single-stranded compound or antisense compound comprises or consists of an oligomeric compound. In certain embodiments, such an oligomeric compound comprises or consists of an oligonucleotide and optionally a conjugate group. In certain embodiments, the oligonucleotide is an antisense oligonucleotide. In certain embodiments, the oligonucleotide is modified. In certain embodiments, the oligonucleotide of a single-stranded antisense compound or oligomeric compound comprises a self-complementary nucleobase sequence.

In certain embodiments, compounds are double-stranded. Such double-stranded compounds comprise a first modified oligonucleotide having a region complementary to a target nucleic acid and a second modified oligonucleotide having a region complementary to the first modified oligonucleotide. In certain embodiments, the modified oligonucleotide is an RNA oligonucleotide. In such embodiments, the thymine nucleobase in the modified oligonucleotide is replaced by a uracil nucleobase. In certain embodiments, compound comprises a conjugate group. In certain embodiments, one of the modified oligonucleotides is conjugated. In certain embodiments, both the modified oligonucleotides are conjugated. In certain embodiments, the first modified oligonucleotide is conjugated. In certain embodiments, the second modified oligonucleotide is conjugated. In certain embodiments, the first modified oligonucleotide consists of 12-30 linked nucleosides and the second modified oligonucleotide consists of 12-30 linked nucleosides. In certain embodiments, one of the modified oligonucleotides has a nucleobase sequence comprising at least 8 contiguous nucleobases of any of SEQ ID NOs: 36-2646 or 2664-2813. In certain embodiments, one of the modified oligonucleotides has a nucleobase sequence comprising at least 8 contiguous nucleobases of any of SEQ ID NOs: 2-10.

In certain embodiments, antisense compounds are double-stranded. Such double-stranded antisense compounds comprise a first oligomeric compound having a region complementary to a target nucleic acid and a second oligomeric compound having a region complementary to the first oligomeric compound. The first oligomeric compound of such double stranded antisense compounds typically comprises or consists of a modified oligonucleotide and optionally a conjugate group. The oligonucleotide of the second oligomeric compound of such double-stranded antisense compound may be modified or unmodified. Either or both oligomeric compounds of a double-stranded antisense compound may comprise a conjugate group. The oligomeric compounds of double-stranded antisense compounds may include non-complementary overhanging nucleosides.

Examples of single-stranded and double-stranded compounds include but are not limited to oligonucleotides, siRNAs, microRNA targeting oligonucleotides, and single-stranded RNAi compounds, such as small hairpin RNAs (shRNAs), single-stranded siRNAs (ssRNAs), and microRNA mimics.

In certain embodiments, a compound described herein has a nucleobase sequence that, when written in the 5' to 3' direction, comprises the reverse complement of the target segment of a target nucleic acid to which it is targeted.

In certain embodiments, a compound described herein comprises an oligonucleotide consisting of 10 to 30 linked subunits. In certain embodiments, a compound described herein comprises an oligonucleotide consisting of 12 to 30 linked subunits. In certain embodiments, a compound described herein comprises an oligonucleotide consisting of 12 to 22 linked subunits. In certain embodiments, a compound described herein comprises an oligonucleotide consisting of 14 to 30 linked subunits. In certain embodiments, compound described herein comprises an oligonucleotide consisting of 14 to 20 linked subunits. In certain embodiments, a compound described herein comprises an oligonucleotide consisting of 15 to 30 linked subunits. In certain embodiments, a compound described herein comprises an oligonucleotide consisting of 15 to 20 linked subunits. In certain embodiments, a compound described herein comprises an oligonucleotide consisting of 16 to 30 linked subunits. In certain embodiments, a compound described herein comprises an oligonucleotide consisting of 16 to 20 linked subunits. In certain embodiments, a compound described herein comprises an oligonucleotide consisting of 17 to 30 linked subunits. In certain embodiments, a compound described herein comprises an oligonucleotide consisting of 17 to 20 linked subunits. In certain embodiments, a compound described herein comprises an oligonucleotide consisting of 18 to 30 linked subunits. In certain embodiments, a compound described herein comprises an oligonucleotide consisting of 18 to 21 linked subunits. In certain embodiments, a compound described herein comprises an oligonucleotide consisting of 18 to 20 linked subunits. In certain embodiments, a compound described herein comprises an oligonucleotide consisting of 20 to 30 linked subunits. In other words, such oligonucleotides consist of 12 to 30 linked subunits, 14 to 30 linked subunits, 14 to 20 subunits, 15 to 30 subunits, 15 to 20 subunits, 16 to 30 subunits, 16 to 20 subunits, 17 to 30 subunits, 17 to 20 subunits, 18 to 30 subunits, 18 to 20 subunits, 18 to 21 subunits, 20 to 30 subunits, or 12 to 22 linked subunits, respectively. In certain embodiments, a compound described herein comprises an oligonucleotide consisting of 14 linked subunits. In certain embodiments, a compound described herein comprises an oligonucleotide consisting of 16 linked subunits. In certain embodiments, a compound described herein comprises an oligonucleotide consisting of 17 linked subunits. In certain embodiments, compound described herein comprises an oligonucleotide consisting of 18 linked subunits. In certain embodiments, a compound described herein comprises an oligonucleotide consisting of 19 linked subunits. In certain embodiments, a compound described herein comprises an oligonucleotide consisting of 20 linked subunits. In other embodiments, a compound described herein comprises an oligonucleotide consisting of 8 to 80, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked subunits. In certain such embodiments, the compound described herein comprises an oligonucleotide consisting of 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked subunits, or a range defined by any two of the above values. In some embodiments the linked subunits are nucleotides, nucleosides, or nucleobases.

In certain embodiments, the compound may further comprise additional features or elements, such as a conjugate group, that are attached to the oligonucleotide. In certain embodiments, such compounds are antisense compounds. In certain embodiments, such compounds are oligomeric compounds. In embodiments where a conjugate group comprises a nucleoside (i.e. a nucleoside that links the conjugate group to the oligonucleotide), the nucleoside of the conjugate group is not counted in the length of the oligonucleotide.

In certain embodiments, compounds may be shortened or truncated. For example, a single subunit may be deleted from the 5' end (5' truncation), or alternatively from the 3' end (3' truncation). A shortened or truncated compound targeted to an MALAT1 nucleic acid may have two subunits deleted from the 5' end, or alternatively may have two subunits deleted from the 3' end, of the compound. Alternatively, the deleted nucleosides may be dispersed throughout the compound.

When a single additional subunit is present in a lengthened compound, the additional subunit may be located at the 5' or 3' end of the compound. When two or more additional subunits are present, the added subunits may be adjacent to each other, for example, in a compound having two subunits added to the 5' end (5' addition), or alternatively to the 3' end (3' addition), of the compound. Alternatively, the added subunits may be dispersed throughout the compound.

It is possible to increase or decrease the length of a compound, such as an oligonucleotide, and/or introduce mismatch bases without eliminating activity (Woolf et al. *Proc. Natl. Acad. Sci. USA* 1992, 89:7305-7309; Gautschi et al. *J. Natl. Cancer Inst*. March 2001, 93:463-471; Maher and Dolnick *Nuc. Acid. Res*. 1998, 16:3341-3358). However, seemingly small changes in oligonucleotide sequence, chemistry and motif can make large differences in one or more of the many properties required for clinical development (Seth et al. *J. Med. Chem*. 2009, 52, 10; Egli et al. *J. Am. Chem. Soc*. 2011, 133, 16642).

In certain embodiments, compounds described herein are interfering RNA compounds (RNAi), which include double-stranded RNA compounds (also referred to as short-interfering RNA or siRNA) and single-stranded RNAi compounds (or ssRNA). Such compounds work at least in part through the RISC pathway to degrade and/or sequester a target nucleic acid (thus, include microRNA/microRNA-mimic compounds). As used herein, the term siRNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically modified siRNA, post-transcriptional gene silencing RNA (ptgsRNA), and others. In addition, as used herein, the term "RNAi" is meant to be equivalent to other terms used to describe sequence specific RNA interference, such as post transcriptional gene silencing, translational inhibition, or epigenetics.

In certain embodiments, a compound described herein can comprise any of the oligonucleotide sequences targeted to MALAT1 described herein. In certain embodiments, the compound can be double-stranded. In certain embodiments, the compound comprises a first strand comprising at least an 8, 9, 10, 11, 12, 13, 14, 15, 16, 17, 18, 19, or 20 contiguous nucleobase portion of any one of SEQ ID NOs: 2-10 or 36-2813 and a second strand. In certain embodiments, the compound comprises a first strand comprising the nucleobase sequence of any one of SEQ ID NOs: 2-10 or 36-2813 and a second strand. In certain embodiments, the compound comprises ribonucleotides in which the first strand has uracil (U) in place of thymine (T) in any one of SEQ ID NOs: 2-10 or 36-2813. In certain embodiments, the compound comprises (i) a first strand comprising a nucleobase sequence complementary to the site on MALAT1 to which any of SEQ ID NOs: 2-10 or 36-2813 is targeted, and (ii) a second strand. In certain embodiments, the compound comprises a first strand comprising at least an 8, 9, 10, 11, 12, 13, 14, 15, 16, 17, 18, 19, or 20 contiguous nucleobase portion of any one of SEQ ID NOs: 2-10 and a second strand. In certain embodiments, the compound comprises a first strand comprising the nucleobase sequence of any one of SEQ ID NOs: 2-10 and a second strand. In certain embodiments, the compound comprises ribonucleotides in which the first strand has uracil (U) in place of thymine (T) in any one of SEQ ID NOs: 2-10. In certain embodiments, the compound comprises (i) a first strand comprising a nucleobase sequence complementary to the site on MALAT1 to which any of SEQ ID NOs: 2-10 is targeted, and (ii) a second strand. In certain embodiments, the compound comprises one or more modified nucleotides in which the 2' position in the sugar contains a halogen (such as fluorine group; 2'-F) or contains an alkoxy group (such as a methoxy group; 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the dsRNA compound. In certain embodiments, the compound comprises one or more linkages between adjacent nucleotides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains one or two capped strands, as disclosed, for example, by WO 00/63364, filed Apr. 19, 2000.

In certain embodiments, the first strand of the compound is an siRNA guide strand and the second strand of the compound is an siRNA passenger strand. In certain embodiments, the second strand of the compound is complementary to the first strand. In certain embodiments, each strand of the compound consisting of 16, 17, 18, 19, 20, 21, 22, or 23 linked nucleosides. In certain embodiments, the first or second strand of the compound can comprise a conjugate group.

In certain embodiments, a compound described herein can comprise any of the oligonucleotide sequences targeted to MALAT1 described herein. In certain embodiments, the compound is single stranded. In certain embodiments, such a compound is a single-stranded RNAi (ssRNAi) compound. In certain embodiments, the compound comprises at least an 8, 9, 10, 11, 12, 13, 14, 15, 16, 17, 18, 19, or 20 contiguous nucleobase portion of any one of SEQ ID NOs: 2-10 or 36-2813. In certain embodiments, the compound comprises the nucleobase sequence of any one of SEQ ID NOs: 2-10 or 36-2813. In certain embodiments, the compound comprises ribonucleotides in which uracil (U) is in place of thymine (T) in any one of SEQ ID NOs: 2-10 or 36-2813. In certain embodiments, the compound comprises a nucleobase sequence complementary to the site on MALAT1 to which any of SEQ ID NOs: 2-10 or 36-2813 is targeted. In certain embodiments, the compound comprises at least an 8, 9, 10, 11, 12, 13, 14, 15, 16, 17, 18, 19, or 20 contiguous nucleobase portion of any one of SEQ ID NOs: 2-10. In certain embodiments, the compound comprises the nucleobase sequence of any one of SEQ ID NOs: 2-10. In certain embodiments, the compound comprises ribonucleotides in which uracil (U) is in place of thymine (T) in any one of SEQ ID NOs: 2-10. In certain embodiments, the compound comprises a nucleobase sequence complementary to the site on MALAT1 to which any of SEQ ID NOs: 2-10 is targeted. In certain embodiments, the compound comprises one or more modified nucleotides in which the 2' position in the sugar contains a halogen (such as fluorine group; 2'-F) or contains an alkoxy group (such as a methoxy group; 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the compound. In certain embodiments, the compound comprises one or more linkages between adjacent nucleotides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains a capped strand, as disclosed, for example, by WO 00/63364, filed Apr. 19, 2000. In certain embodiments, the compound consists of 16, 17, 18, 19, 20, 21, 22, or 23 linked nucleosides. In certain embodiments, the compound can comprise a conjugate group.

In certain embodiments, compounds described herein comprise modified oligonucleotides. Certain modified oligonucleotides have one or more asymmetric center and thus give rise to enantiomers, diastereomers, and other stereoisomeric configurations that may be defined, in terms of absolute stereochemistry, as (R) or (S), as a or β such as for sugar anomers, or as (D) or (L) such as for amino acids etc. Included in the modified oligonucleotides provided herein are all such possible isomers, including their racemic and optically pure forms, unless specified otherwise. Likewise, all cis- and trans-isomers and tautomeric forms are also included.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^1$H hydrogen atoms. Isotopic substitutions encompassed by the compounds herein include but are not limited to: $^2$H or $^3$H in place of $^1$H, $^{13}$C or $^{14}$C in place of $^{15}$N in place of $^{14}$N, $^{17}$O or $^{18}$O in place of $^{16}$O, and $^{33}$S, $^{34}$S, $^{35}$S, or $^{36}$S in place of $^{32}$S. In certain embodiments, non-radioactive isotopic substitutions may impart new properties on the compound that are beneficial for use as a therapeutic or research tool. In certain embodiments, radioactive isotopic substitutions may make the compound suitable for research or diagnostic purposes, such as an imaging assay.

Certain Mechanisms

In certain embodiments, compounds described herein comprise or consist of modified oligonucleotides. In certain embodiments, compounds described herein are antisense compounds. In certain embodiments, compounds comprise oligomeric compounds. In certain embodiments, compounds described herein are capable of hybridizing to a target nucleic acid, resulting in at least one antisense activity. In certain embodiments, compounds described herein selectively affect one or more target nucleic acid. Such compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in a significant undesired antisense activity.

In certain antisense activities, hybridization of a compound described herein to a target nucleic acid results in recruitment of a protein that cleaves the target nucleic acid. For example, certain compounds described herein result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, compounds described herein are sufficiently "DNA-like" to elicit RNase H activity. Further, in certain embodiments, one or more non-DNA-like nucleoside in the gap of a gapmer is tolerated.

In certain antisense activities, compounds described herein or a portion of the compound is loaded into an RNA-induced silencing complex (RISC), ultimately resulting in cleavage of the target nucleic acid. For example, certain compounds described herein result in cleavage of the target nucleic acid by Argonaute. Compounds that are loaded into RISC are RNAi compounds. RNAi compounds may be double-stranded (siRNA) or single-stranded (ssRNA).

In certain embodiments, hybridization of compounds described herein to a target nucleic acid does not result in recruitment of a protein that cleaves that target nucleic acid. In certain such embodiments, hybridization of the compound to the target nucleic acid results in alteration of splicing of the target nucleic acid. In certain embodiments, hybridization of the compound to a target nucleic acid results in inhibition of a binding interaction between the target nucleic acid and a protein or other nucleic acid. In certain such embodiments, hybridization of the compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein, and/or a phenotypic change in a cell or animal.

Target Nucleic Acids, Target Regions and Nucleotide Sequences

In certain embodiments, compounds described herein comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: an mRNA and a pre-mRNA, including intronic, exonic and untranslated regions. In certain embodiments, the target RNA is an mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron.

Nucleotide sequences that encode MALAT1 include, without limitation, the following: RefSEQ No. XR_001309.1 (SEQ ID NO: 1), which is incorporated by reference in its entirety.

Hybridization

In some embodiments, hybridization occurs between a compound disclosed herein and a MALAT1 nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Hybridization conditions are sequence-dependent and are determined by the nature and composition of the nucleic acid molecules to be hybridized.

Methods of determining whether a sequence is specifically hybridizable to a target nucleic acid are well known in the art. In certain embodiments, the compounds provided herein are specifically hybridizable with a MALAT1 nucleic acid.

Complementarity

An oligonucleotide is said to be complementary to another nucleic acid when the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to the following pairs: adenine (A) and thymine (T), adenine (A) and uracil (U), cytosine (C) and guanine (G), and 5-methyl cytosine (mC) and guanine (G) unless otherwise specified. Complementary oligonucleotides and/or nucleic acids need not have nucleobase complementarity at each nucleoside and may include one or more nucleobase mismatches. An oligonucleotide is fully complementary or 100% complementary when such oligonucleotides have nucleobase matches at each nucleoside without any nucleobase mismatches.

In certain embodiments, compounds described herein comprise or consist of modified oligonucleotides. In certain embodiments, compounds described herein are antisense compounds. In certain embodiments, compounds comprise oligomeric compounds. Non-complementary nucleobases between a compound and a MALAT1 nucleic acid may be tolerated provided that the compound remains able to specifically hybridize to a target nucleic acid. Moreover, a compound may hybridize over one or more segments of a MALAT1 nucleic acid such that intervening or adjacent segments are not involved in the hybridization event (e.g., a loop structure, mismatch or hairpin structure).

In certain embodiments, the compounds provided herein, or a specified portion thereof, are, are at least, or are up to 70%, 80%, 85%, 86%, 87%, 88%, 89%, 90%, 91%, 92%, 93%, 94%, 95%, 96%, 97%, 98%, 99%, or 100% complementary to a MALAT1 nucleic acid, a target region, target segment, or specified portion thereof. In certain embodiments, the compounds provided herein, or a specified portion thereof, are 70% to 75%, 75% to 80%, 80% to 85%, 85% to 90%, 90% to 95%, 95% to 100%, or any number in between these ranges, complementary to a MALAT1 nucleic acid, a target region, target segment, or specified portion thereof. Percent complementarity of a compound with a target nucleic acid can be determined using routine methods.

For example, a compound in which 18 of 20 nucleobases of the compound are complementary to a target region, and would therefore specifically hybridize, would represent 90 percent complementarity. In this example, the remaining non-complementary nucleobases may be clustered or interspersed with complementary nucleobases and need not be contiguous to each other or to complementary nucleobases. As such, a compound which consisting of 18 nucleobases having four non-complementary nucleobases which are flanked by two regions of complete complementarity with the target nucleic acid would have 77.8% overall complementarity with the target nucleic acid. Percent complementarity of a compound with a region of a target nucleic acid can be determined routinely using BLAST programs (basic local alignment search tools) and PowerBLAST programs known in the art (Altschul et al., *J. Mol. Biol.*, 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, compounds described herein, or specified portions thereof, are fully complementary (i.e. 100% complementary) to a target nucleic acid, or specified portion thereof. For example, a compound may be fully complementary to a MALAT1 nucleic acid, or a target region, or a target segment or target sequence thereof. As used herein, "fully complementary" means each nucleobase of a compound is complementary to the corresponding nucleobase of a target nucleic acid. For example, a 20 nucleobase compound is fully complementary to a target sequence that is 400 nucleobases long, so long as there is a corresponding 20 nucleobase portion of the target nucleic acid that is fully complementary to the compound. Fully complementary can also be used in reference to a specified portion of the first and/or the second nucleic acid. For example, a 20 nucleobase portion of a 30 nucleobase compound can be "fully complementary" to a target sequence that is 400 nucleobases long. The 20 nucleobase portion of the 30 nucleobase compound is fully complementary to the target sequence if the target sequence has a corresponding 20 nucleobase portion wherein each nucleobase is complementary to the 20 nucleobase portion of the compound. At the same time, the entire 30 nucleobase compound may or may not be fully complementary to the target sequence, depending on whether the remaining 10 nucleobases of the compound are also complementary to the target sequence.

In certain embodiments, compounds described herein comprise one or more mismatched nucleobases relative to the target nucleic acid. In certain such embodiments, antisense activity against the target is reduced by such mismatch, but activity against a non-target is reduced by a greater amount. Thus, in certain such embodiments selectivity of the compound is improved. In certain embodiments, the mismatch is specifically positioned within an oligonucleotide having a gapmer motif. In certain such embodiments, the mismatch is at position 1, 2, 3, 4, 5, 6, 7, or 8 from the 5'-end of the gap region. In certain such embodiments, the mismatch is at position 9, 8, 7, 6, 5, 4, 3, 2, 1 from the 3'-end of the gap region. In certain such embodiments, the mismatch is at position 1, 2, 3, or 4 from the 5'-end of the wing region. In certain such embodiments, the mismatch is at position 4, 3, 2, or 1 from the 3'-end of the wing region. In certain embodiments, the mismatch is specifically positioned within an oligonucleotide not having a gapmer motif. In certain such embodiments, the mismatch is at position 1, 2, 3, 4, 5, 6, 7, 8, 9, 10, 11, or 12 from the 5'-end of the oligonucleotide. In certain such embodiments, the mismatch is at position, 2, 3, 4, 5, 6, 7, 8, 9, 10, 11, or 12 from the 3'-end of the oligonucleotide.

The location of a non-complementary nucleobase may be at the 5' end or 3' end of the compound. Alternatively, the non-complementary nucleobase or nucleobases may be at an internal position of the compound. When two or more non-complementary nucleobases are present, they may be contiguous (i.e. linked) or non-contiguous. In one embodiment, a non-complementary nucleobase is located in the wing segment of a gapmer oligonucleotide.

In certain embodiments, compounds described herein that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a MALAT1 nucleic acid, or specified portion thereof.

In certain embodiments, compounds described herein that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a MALAT1 nucleic acid, or specified portion thereof.

In certain embodiments, compounds described herein also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of a compound. In certain embodiments, the— compounds, are complementary to at least an 8 nucleobase portion of a target segment. In certain embodiments, the compounds are complementary to at least a 9 nucleobase portion of a target segment. In certain embodiments, the compounds are complementary to at least a 10 nucleobase portion of a target segment. In certain embodiments, the compounds are complementary to at least an 11 nucleobase portion of a target segment. In certain embodiments, the compounds are complementary to at least a 12 nucleobase portion of a target segment. In certain embodiments, the compounds are complementary to at least a 13 nucleobase portion of a target segment.

In certain embodiments, the compounds are complementary to at least a 14 nucleobase portion of a target segment. In certain embodiments, the compounds are complementary to at least a 15 nucleobase portion of a target segment. In certain embodiments, the compounds are complementary to at least a 16 nucleobase portion of a target segment. Also contemplated are compounds that are complementary to at least a 9, 10, 11, 12, 13, 14, 15, 16, 17, 18, 19, 20, or more nucleobase portion of a target segment, or a range defined by any two of these values.

Identity

The compounds provided herein may also have a defined percent identity to a particular nucleotide sequence, SEQ ID NO, or compound represented by a specific ION number, or portion thereof. In certain embodiments, compounds described herein are antisense compounds or oligomeric compounds. In certain embodiments, compounds described herein are modified oligonucleotides. As used herein, a compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the compounds described herein as well as compounds having non-identical bases relative to the compounds provided herein also are contemplated. The non-identical bases may be adjacent to each other or dispersed throughout the compound. Percent identity of a compound is calculated according to the number of bases that have identical base pairing relative to the sequence to which it is being compared.

In certain embodiments, compounds described herein, or portions thereof, are, or are at least, 70%, 75%, 80%, 85%, 90%, 91%, 92%, 93%, 94%, 95%, 96%, 97%, 98%, 99% or 100% identical to one or more of the compounds or SEQ ID NOs, or a portion thereof, disclosed herein. In certain embodiments, compounds described herein are about 70%, 75%, 80%, 85%, 90%, 91%, 92%, 93%, 94%, 95%, 96%, 97%, 98%, or 99% identical, or any percentage between such values, to a particular nucleotide sequence, SEQ ID NO, or compound represented by a specific ION number, or portion thereof, in which the compounds comprise an oligonucleotide having one or more mismatched nucleobases. In certain such embodiments, the mismatch is at position 1, 2, 3, 4, 5, 6, 7, 8, 9, 10, 11, or 12 from the 5'-end of the oligonucleotide. In certain such embodiments, the mismatch is at position, 2, 3, 4, 5, 6, 7, 8, 9, 10, 11, or 12 from the 3'-end of the oligonucleotide.

In certain embodiments, compounds described herein comprise or consist of antisense compounds. In certain embodiments, a portion of the antisense compound is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

In certain embodiments, compounds described herein comprise or consist of oligonucleotides. In certain embodiments, a portion of the oligonucleotide is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

Certain Modified Compounds

In certain embodiments, compounds described herein comprise or consist of oligonucleotides consisting of linked nucleosides. Oligonucleotides may be unmodified oligonucleotides (RNA or DNA) or may be modified oligonucleotides. Modified oligonucleotides comprise at least one modification relative to unmodified RNA or DNA (i.e., comprise at least one modified nucleoside (comprising a modified sugar moiety and/or a modified nucleobase) and/or at least one modified internucleoside linkage).

A. Modified Nucleosides

Modified nucleosides comprise a modified sugar moiety or a modified nucleobase or both a modified sugar moiety and a modified nucleobase.

1. Modified Sugar Moieties

In certain embodiments, sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more acyclic substituent, including but not limited to substituents at the 2', 4', and/or 5' positions. In certain embodiments one or more acyclic substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for linearly non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5'-methyl (R or S), 5'-vinyl, and 5'-methoxy. In certain embodiments, non-bicyclic modified sugars comprise more than one non-bridging sugar substituent, for example, 2'-F-5'-methyl sugar moieties and the modified sugar moieties and modified nucleosides described in Migawa et al., US2010/190837 and Rajeev et al., US2013/0203836.

In certain embodiments, a 2'-substituted nucleoside or 2'-non-bicyclic modified nucleoside comprises a sugar moiety comprising a linear 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ON(R$_m$)(R$_n$), O(CH$_2$)$_2$O(CH$_2$)$_2$N(CH$_3$)$_2$, and N-substituted acetamide (OCH$_2$C(=O)—N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted nucleoside or 2'-non-bicyclic modified nucleoside comprises a sugar moiety comprising a linear 2'-substituent group selected from: F, OCF$_3$, OCH$_3$, OCH$_2$CH$_2$OCH$_3$, O(CH$_2$)$_2$SCH$_3$, O(CH$_2$)$_2$ON(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted nucleoside or 2'-non-bicyclic modified nucleoside comprises a sugar moiety comprising a linear 2'-substituent group selected from: F, OCH$_3$, and OCH$_2$CH$_2$OCH$_3$.

Nucleosides comprising modified sugar moieties, such as non-bicyclic modified sugar moieties, are referred to by the position(s) of the substitution(s) on the sugar moiety of the nucleoside. For example, nucleosides comprising 2'-substituted or 2-modified sugar moieties are referred to as 2'-substituted nucleosides or 2-modified nucleosides.

Certain modified sugar moieties comprise a bridging sugar substituent that forms a second ring resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-CH$_2$-2', 4'-(CH$_2$)$_2$-2', 4'-(CH$_2$)$_3$-2', 4'-CH$_2$—O-2' ("LNA"), 4'-CH$_2$—S-2', 4'-(CH$_2$)$_2$—O-2' ("ENA"), 4'-CH(CH$_3$)—O-2' (referred to as "constrained ethyl" or "cEt" when in the S configuration), 4'-CH$_2$—O—CH$_2$-2', 4'-CH$_2$—N(R)-2', 4'-CH(CH$_2$OCH$_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C(CH$_3$)(CH$_3$)—O-2' and analogs thereof (see, e.g., Seth et al., U.S. Pat. No. 8,278,283), 4'-CH$_2$—N(OCH$_3$)-2' and analogs thereof (see, e.g., Prakash et al., U.S. Pat. No. 8,278,425), 4'-CH$_2$—O—N(CH$_3$)-2' (see, e.g., Allerson et al., U.S. Pat. No. 7,696,345 and Allerson et al., U.S. Pat. No. 8,124,745), 4'-CH$_2$—C(H)(CH$_3$)-2' (see, e.g., Zhou, et al., *J. Org. Chem.*, 2009, 74, 118-134), 4'-CH$_2$—C(=CH$_2$)-2' and analogs thereof (see e.g., Seth et al., U.S. Pat. No. 8,278,426), 4'-C(R$_a$R$_b$)—N(R)—O-2', 4'-C(R$_a$R$_b$)—O—N(R)-2', 4'-CH$_2$—O—N(R)-2', and 4'-CH$_2$—N(R)—O-2', wherein each R, R$_a$, and R$_b$ is, independently, H, a protecting group, or C$_1$-C$_{12}$ alkyl (see, e.g. Imanishi et al., U.S. Pat. No. 7,427,672).

In certain embodiments, such 4' to 2' bridges independently comprise from 1 to 4 linked groups independently selected from: —[C(R$_a$)(R$_b$)]$_n$—, —[C(R$_a$)(R$_b$)]$_n$—O—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_n$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl, or a protecting group.

Additional bicyclic sugar moieties are known in the art, see, for example: Freier et al., *Nucleic Acids Research*, 1997, 25(22), 4429-4443, Albaek et al., *J. Org. Chem.*, 2006, 71, 7731-7740, Singh et al., *Chem. Commun.*, 1998, 4, 455-456; Koshkin et al., *Tetrahedron*, 1998, 54, 3607-3630; Wahlestedt et al., *Proc. Natl. Acad. Sci. U S A.*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 2007, 129, 8362-8379; Elayadi et al., *Curr. Opinion Invens. Drugs*, 2001, 2, 558-561; Braasch et al., *Chem. Biol.*, 2001, 8, 1-7; Orum et al., *Curr. Opinion Mol. Ther.*, 2001, 3, 239-243; Wengel et al., U.S. Pat. No. 7,053,207, Imanishi et al., U.S. Pat. No. 6,268,490, Imanishi et al. U.S. Pat. No. 6,770,748, Imanishi et al., U.S. RE44,779; Wengel et al., U.S. Pat. No. 6,794,499, Wengel et al., U.S. Pat. No. 6,670,461; Wengel et al., U.S. Pat. No. 7,034,133, Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191, Torsten et al., WO 2004/106356, Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; Allerson et al., US2008/0039618; and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

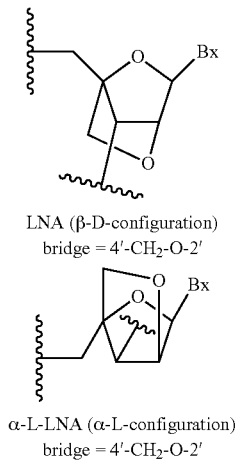

LNA (β-D-configuration)
bridge = 4'-CH$_2$-O-2'

α-L-LNA (α-L-configuration)
bridge = 4'-CH$_2$-O-2'

α-L-methyleneoxy (4'-CH$_2$—O-2') or α-L-LNA bicyclic nucleosides have been incorporated into oligonucleotides that showed antisense activity (Frieden et al., *Nucleic Acids Research*, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see e.g., Leumann, C J. *Bioorg. & Med. Chem.* 2002, 10, 841-854), fluoro HNA:

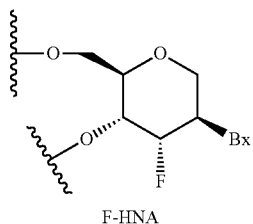

F-HNA ("F-HNA", see e.g., Swayze et al., U.S. Pat. No. 8,088,904; Swayze et al., U.S. Pat. No. 8,440,803; and Swayze et al., U.S. Pat. No. 9,005,906, F-HNA can also be referred to as a F-THP or 3'-fluoro tetrahydropyran), and nucleosides comprising additional modified THP compounds having the formula:

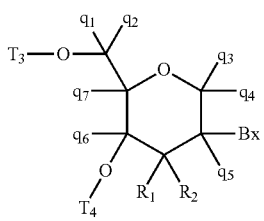

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group; $q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

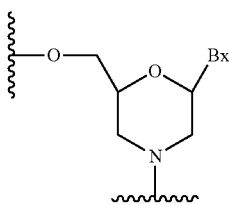

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., Org. Biomol. Chem., 2013, 11, 5853-5865), and nucleosides and oligonucleotides described in Manoharan et al., US2013/130378.

Many other bicyclic and tricyclic sugar and sugar surrogate ring systems are known in the art that can be used in modified nucleosides.

2. Modified Nucleobases

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can impart nuclease stability, binding affinity or some other beneficial biological property to antisense compounds.

In certain embodiments, compounds described herein comprise modified oligonucleotides. In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and O-6 substituted purines. In certain embodiments, modified nucleobases are selected from: 2-aminopropyladenine, 5-hydroxymethyl cytosine, 5-methylcytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl ($C=C—CH_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp).

Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in The Concise Encyclopedia Of Polymer Science And Engineering, Kroschwitz, J. I., Ed., John Wiley & Sons, 1990, 858-859; Englisch et al., Angewandte Chemie, International Edition, 1991, 30, 613; Sanghvi, Y. S., Chapter 15, Antisense Research and Applications, Crooke, S. T. and Lebleu, B., Eds., CRC Press, 1993, 273-288; and those disclosed in Chapters 6 and 15, Antisense Drug Technology, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403, Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., U.S. Pat. No. 6,166,199; and Matteucci et al., U.S. Pat. No. 6,005,096.

In certain embodiments, compounds targeted to a MALAT1 nucleic acid comprise one or more modified nucleobases. In certain embodiments, the modified nucleobase is 5-methylcytosine. In certain embodiments, each cytosine is a 5-methylcytosine.

3. Modified Internucleoside Linkages

The naturally occurring internucleoside linkage of RNA and DNA is a 3' to 5' phosphodiester linkage In certain embodiments, compounds described herein having one or more modified, i.e. non-naturally occurring, internucleoside linkages are often selected over compounds having naturally occurring internucleoside linkages because of desirable properties such as, for example, enhanced cellular uptake, enhanced affinity for target nucleic acids, and increased stability in the presence of nucleases.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

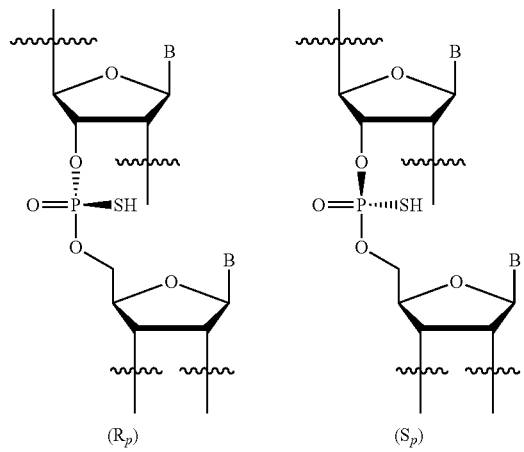

Unless otherwise indicated, chiral internucleoside linkages of modified oligonucleotides described herein can be stereorandom or in a particular stereochemical configuration.

In certain embodiments, compounds targeted to an MALAT1 nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

In certain embodiments, compounds described herein comprise oligonucleotides. Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS—P=S"). Representative non-phosphorus containing internucleoside linking groups include but are not limited to methylenemethylimino (—CH2-N(CH3)-O—CH2-), thiodiester, thionocarbamate (—O—C(=O)(NH)—S—); siloxane (—O—SiH2-O—); and N,N'-dimethylhydrazine (—CH2-N(CH3)-N(CH3)-). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Representative chiral internucleoside linkages include but are not limited to alkylphosphonates and phosphorothioates. Methods of preparation of phosphorous-containing and non-phosphorous-containing internucleoside linkages are well known to those skilled in the art.

Neutral internucleoside linkages include, without limitation, phosphotriesters, methylphosphonates, MMI (3'-CH2-N(CH3)-O-5'), amide-3 (3'-CH2-C(=O)—N(H)-5'), amide-4 (3'-CH2-N(H)—C(=O)-5'), formacetal (3'-O—CH2-O-5'), methoxypropyl, and thioformacetal (3'-S—CH2-O-5'). Further neutral internucleoside linkages include nonionic linkages comprising siloxane (dialkylsiloxane), carboxylate ester, carboxamide, sulfide, sulfonate ester and amides (See for example: Carbohydrate Modifications in Antisense Research; Y. S. Sanghvi and P. D. Cook, Eds., ACS Symposium Series 580; Chapters 3 and 4, 40-65). Further neutral internucleoside linkages include nonionic linkages comprising mixed N, O, S and $CH_2$ component parts.

In certain embodiments, oligonucleotides comprise modified internucleoside linkages arranged along the oligonucleotide or region thereof in a defined pattern or modified internucleoside linkage motif. In certain embodiments, internucleoside linkages are arranged in a gapped motif. In such embodiments, the internucleoside linkages in each of two wing regions are different from the internucleoside linkages in the gap region. In certain embodiments the internucleoside linkages in the wings are phosphodiester and the internucleoside linkages in the gap are phosphorothioate. The nucleoside motif is independently selected, so such oligonucleotides having a gapped internucleoside linkage motif may or may not have a gapped nucleoside motif and if it does have a gapped nucleoside motif, the wing and gap lengths may or may not be the same.

In certain embodiments, oligonucleotides comprise a region having an alternating internucleoside linkage motif.

In certain embodiments, oligonucleotides comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

In certain embodiments, oligonucleotides comprise one or more methylphosphonate linkages. In certain embodiments, oligonucleotides having a gapmer nucleoside motif comprise a linkage motif comprising all phosphorothioate linkages except for one or two methylphosphonate linkages. In certain embodiments, one methylphosphonate linkage is in the central gap of an oligonucleotide having a gapmer nucleoside motif.

In certain embodiments, it is desirable to arrange the number of phosphorothioate internucleoside linkages and phosphodiester internucleoside linkages to maintain nuclease resistance. In certain embodiments, it is desirable to arrange the number and position of phosphorothioate internucleoside linkages and the number and position of phosphodiester internucleoside linkages to maintain nuclease resistance. In certain embodiments, the number of phosphorothioate internucleoside linkages may be decreased and the number of phosphodiester internucleoside linkages may be increased. In certain embodiments, the number of phosphorothioate internucleoside linkages may be decreased and the number of phosphodiester internucleoside linkages may be increased while still maintaining nuclease resistance. In certain embodiments it is desirable to decrease the number of phosphorothioate internucleoside linkages while retaining nuclease resistance. In certain embodiments it is desirable to increase the number of phosphodiester internucleoside linkages while retaining nuclease resistance.

Certain Motifs

In certain embodiments, compounds described herein comprise oligonucleotides. Oligonucleotides can have a motif, e.g. a pattern of unmodified and/or modified sugar moieties, nucleobases, and/or internucleoside linkages. In certain embodiments, modified oligonucleotides comprise one or more modified nucleoside comprising a modified sugar. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

a. Certain Sugar Motifs

In certain embodiments, compounds described herein comprise oligonucleotides. In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which comprises two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-5 nucleosides. In certain embodiments, the wings of a gapmer comprise 2-5 nucleosides. In certain embodiments, the wings of a gapmer comprise 3-5 nucleosides. In certain embodiments, the nucleosides of a gapmer are all modified nucleosides.

In certain embodiments, the gap of a gapmer comprises 7-12 nucleosides. In certain embodiments, the gap of a gapmer comprises 7-10 nucleosides. In certain embodiments, the gap of a gapmer comprises 8-10 nucleosides. In certain embodiments, the gap of a gapmer comprises 10 nucleosides. In certain embodiment, each nucleoside of the gap of a gapmer is an unmodified 2'-deoxy nucleoside.

In certain embodiments, the gapmer is a deoxy gapmer. In such embodiments, the nucleosides on the gap side of each wing/gap junction are unmodified 2'-deoxy nucleosides and the nucleosides on the wing sides of each wing/gap junction are modified nucleosides. In certain such embodiments, each nucleoside of the gap is an unmodified 2'-deoxy nucleoside. In certain such embodiments, each nucleoside of each wing is a modified nucleoside.

In certain embodiments, a modified oligonucleotide has a fully modified sugar motif wherein each nucleoside of the modified oligonucleotide comprises a modified sugar moiety. In certain embodiments, modified oligonucleotides comprise or consist of a region having a fully modified sugar motif wherein each nucleoside of the region comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

In certain embodiments, a modified oligonucleotide can comprise a sugar motif described in Swayze et al., US2010/0197762; Freier et al., US2014/0107330; Freier et al., US2015/0184153; and Seth et al., US2015/0267195, each of which is incorporated by reference in its entirety herein.

Certain embodiments provided herein are directed to modified oligomeric compounds useful for inhibiting target nucleic acid expression, which can be useful for treating, preventing, ameliorating, or slowing progression of a disease associated with such a target nucleic acid. In certain embodiments, the modified oligomeric compounds comprise antisense oligonucleotides that are gapmers having certain sugar motifs. In certain embodiments, the gapmer sugar motifs provided herein can be combined with any nucleobase sequence and any internucleoside linkage motif to form potent antisense oligonucleotides.

In certain embodiments, a method comprises contacting a cell or administering to a subject a compound comprising a modified oligonucleotide consisting of 16 linked nucleosides and having the motif: ekk-d9-kkee, wherein 'd' represents a 2'-deoxyribose sugar, 'k' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide consisting of 16 linked nucleosides and having the motif: k-d9-kekeke, wherein 'd' represents a 2'-deoxyribose sugar, 'k' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide consisting of 16 linked nucleosides and having the motif: kkk-d8-kekek, wherein 'd' represents a 2'-deoxyribose sugar, 'k' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide consisting of 16 linked nucleosides and having the motif: kkk-d9-keke, wherein 'd' represents a 2'-deoxyribose sugar, 'k' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide consisting of 16 linked nucleosides and having the motif: kk-d9-kdkdk, wherein 'd' represents a 2'-deoxyribose sugar, 'k' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a compound comprises a modified oligonucleotide consisting of 16 linked nucleosides and having the motif: kk-d9-eeekk, wherein 'd' represents a 2'-deoxyribose sugar, 'k' represents a cEt nucleoside, and 'e' represents a 2'-MOE nucleoside. In certain embodiments, a method comprises contacting a cell or administering to a subject a compound comprising a modified oligonucleotide consisting of 16 linked nucleosides and having the motif: kk-d9-eeekk, wherein 'd' represents a 2'-deoxyribose sugar, 'k' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide consisting of 16 linked nucleosides and having the motif: kk-d9-ekeke, wherein 'd' represents a 2'-deoxyribose sugar, 'k' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

b. Certain Nucleobase Motifs

In certain embodiments, compounds described herein comprise oligonucleotides. In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methylcytosines.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

c. Certain Internucleoside Linkage Motifs

In certain embodiments, compounds described herein comprise oligonucleotides. In certain embodiments, oligonucleotides comprise modified and/or unmodified internucleoside linkages arranged along the oligonucleotide or region thereof in a defined pattern or motif. In certain embodiments, essentially each internucleoside linking group is a phosphate internucleoside linkage (P=O). In certain embodiments, each internucleoside linking group of a modified oligonucleotide is a phosphorothioate (P=S). In certain embodiments, each internucleoside linking group of a modified oligonucleotide is independently selected from a phosphorothioate and phosphate internucleoside linkage. In certain embodiments, the sugar motif of a modified oligonucleotide is a gapmer and the internucleoside linkages within the gap are all modified. In certain such embodiments, some or all of the internucleoside linkages in the wings are unmodified phosphate linkages. In certain embodiments, the terminal internucleoside linkages are modified.

4. Certain Modified Oligonucleotides

In certain embodiments, compounds described herein comprise modified oligonucleotides. In certain embodiments, the above modifications (sugar, nucleobase, internucleoside linkage) are incorporated into a modified oligonucleotide. In certain embodiments, modified oligonucleotides are characterized by their modification, motifs, and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such gapmer oligonucleotides may comprise one or more modified nucleobase independent of the gapmer pattern of the sugar modifications. Furthermore, in certain instances, an oligonucleotide is described by an overall length or range and by lengths or length ranges of two or more regions (e.g., a regions of nucleosides having specified sugar modifications), in such circumstances it may be possible to select numbers for each range that result in an oligonucleotide having an overall length falling outside the specified range. In such circumstances, both elements must be satisfied. For example, in certain embodiments, a modified oligonucleotide consists of 15-20 linked nucleosides and has a sugar motif consisting of three regions, A, B, and C, wherein region A consists of 2-6 linked nucleosides having a specified sugar motif, region B consists of 6-10 linked nucleosides having a specified sugar motif, and region C consists of 2-6 linked nucleosides having a specified sugar motif. Such embodiments do not include modified oligonucleotides where A and C each consist of 6 linked nucleosides and B consists of 10 linked nucleosides (even though those numbers of nucleosides are permitted within the requirements for A, B, and C) because the overall length of such oligonucleotide is 22, which exceeds the upper limit of the overall length of the modified oligonucleotide (20). Herein, if a description of an oligonucleotide is silent with respect to one or more parameter, such parameter is not limited. Thus, a modified oligonucleotide described only as having a gapmer sugar motif without further description may have any length, internucleoside linkage motif, and nucleobase motif. Unless otherwise indicated, all modifications are independent of nucleobase sequence.

Certain Conjugated Compounds

In certain embodiments, the compounds described herein comprise or consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

In certain embodiments, the oligonucleotide is modified. In certain embodiments, the oligonucleotide of a compound has a nucleobase sequence that is complementary to a target nucleic acid. In certain embodiments, oligonucleotides are complementary to a messenger RNA (mRNA). In certain embodiments, oligonucleotides are complementary to a sense transcript.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance In certain embodiments, conjugate groups impart a new property on the attached oligonucleotide, e.g., fluorophores or reporter groups that enable detection of the oligonucleotide.

Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., *Bioorg. Med. Chem. Lett.,* 1994, 4, 1053-1060), a thioether, e.g., hexyl-S-tritylthiol (Manoharan et al., *Ann. N.Y. Acad. Sci.,* 1992, 660, 306-309; Manoharan et al., *Bioorg. Med. Chem. Lett.,* 1993, 3, 2765-2770), a thiocholesterol (Oberhauser et al., *Nucl. Acids Res.,* 1992, 20, 533-538), an aliphatic chain, e.g., do-decan-diol or undecyl residues (Saison-Behmoaras et al., *EMBO* 1, 1991, 10, 1111-1118; Kabanov et al., *FEBS Lett.,* 1990, 259, 327-330; Svinarchuk et al., *Biochimie,* 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.,* 1995, 36, 3651-3654; Shea et al., *Nucl. Acids Res.,* 1990, 18, 3777-3783), a polyamine or a polyethylene glycol chain (Manoharan et al., *Nucleosides & Nucleotides,* 1995, 14, 969-973), or adamantane acetic, a palmityl moiety (Mishra et al., *Biochim. Biophys. Acta,* 1995, 1264, 229-237), an octadecylamine or hexylamino-carbonyl-oxycholesterol moiety (Crooke et al., *J. Pharmacol. Exp. Ther.,* 1996, i, 923-937), a tocopherol group (Nishina et al., *Molecular Therapy Nucleic Acids,* 2015, 4, e220; doi:10.1038/mtna.2014.72 and Nishina et al., *Molecular Therapy,* 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates (e.g., GalNAc), vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain compounds, a conjugate group is a single chemical bond (i.e. conjugate moiety is attached to an oligonucleotide via a conjugate linker through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. It is typically desirable for linker-nucleosides to be cleaved from the compound after it reaches a target tissue. Accordingly, linker-nucleosides are typically linked to one another and to the remainder of the compound through cleavable bonds. In certain embodiments, such cleavable bonds are phosphodiester bonds.

Herein, linker-nucleosides are not considered to be part of the oligonucleotide. Accordingly, in embodiments in which a compound comprises an oligonucleotide consisting of a specified number or range of linked nucleosides and/or a specified percent complementarity to a reference nucleic acid and the compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, a compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such a compound is more than 30. Alternatively, an compound may comprise a modified oligonucleotide consisting of 8-30 nucleosides and no conjugate group. The total number of contiguous linked nucleosides in such a compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances compounds comprising a particular conjugate moiety are better taken up by a particular cell type, but once the compound has been taken up, it is desirable that the conjugate group be cleaved to release the unconjugated or parent oligonucleotide. Thus, certain conjugate may comprise one or more cleavable moieties, typically within the conjugate linker. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, one or more linker-nucleosides are linked to one another and/or to the remainder of the compound through cleavable bonds. In certain embodiments, such cleavable bonds are unmodified phosphodiester bonds. In certain embodiments, a cleavable moiety is 2'-deoxy nucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

Compositions and Methods for Formulating Pharmaceutical Compositions

Compounds described herein may be admixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

Certain embodiments provide pharmaceutical compositions comprising one or more compounds or a salt thereof. In certain embodiments, the compounds are antisense compounds or oligomeric compounds. In certain embodiments, the compounds comprise or consist of a modified oligonucleotide. In certain such embodiments, the pharmaceutical composition comprises a suitable pharmaceutically acceptable diluent or carrier. In certain embodiments, a pharmaceutical composition comprises a sterile saline solution and one or more compound. In certain embodiments, such pharmaceutical composition consists of a sterile saline solution and one or more compound. In certain embodiments, the sterile saline is pharmaceutical grade saline. In certain embodiments, a pharmaceutical composition comprises one or more compound and sterile water. In certain embodiments, a pharmaceutical composition consists of one compound and sterile water. In certain embodiments, the sterile water is pharmaceutical grade water. In certain embodiments, a pharmaceutical composition comprises one or more compound and phosphate-buffered saline (PBS). In certain embodiments, a pharmaceutical composition consists of one or more compound and sterile PBS. In certain embodiments, the sterile PBS is pharmaceutical grade PBS. Compositions and methods for the formulation of pharmaceutical compositions are dependent upon a number of criteria, including, but not limited to, route of administration, extent of disease, or dose to be administered.

A compound described herein targeted to MALAT1 nucleic acid can be utilized in pharmaceutical compositions by combining the compound with a suitable pharmaceutically acceptable diluent or carrier. In certain embodiments, a pharmaceutically acceptable diluent is water, such as sterile water suitable for injection. Accordingly, in one embodiment, employed in the methods described herein is a pharmaceutical composition comprising a compound targeted to MALAT1 nucleic acid and a pharmaceutically acceptable diluent. In certain embodiments, the pharmaceutically acceptable diluent is water. In certain embodiments, the compound comprises or consists of a modified oligonucleotide provided herein.

Pharmaceutical compositions comprising compounds provided herein encompass any pharmaceutically acceptable salts, esters, or salts of such esters, or any other oligonucleotide which, upon administration to an animal, including a human, is capable of providing (directly or indirectly) the biologically active metabolite or residue thereof. In certain embodiments, the compounds are antisense compounds or oligomeric compounds. In certain embodiments, the compound comprises or consists of a modified oligonucleotide. Accordingly, for example, the disclosure is also drawn to pharmaceutically acceptable salts of compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of a compound which are cleaved by endogenous nucleases within the body, to form the active compound.

In certain embodiments, the compounds or compositions further comprise a pharmaceutically acceptable carrier or diluent.

EXAMPLES

Non-Limiting Disclosure and Incorporation by Reference

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH for the natural 2'-H of DNA) or as an RNA having a modified base (thymine (methylated uracil) for natural uracil of RNA).

Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligonucleotide having the nucleobase sequence "ATCGATCG" encompasses any oligonucleotides having such nucleobase sequence, whether modified or unmodified, including, but not limited to, such compounds comprising RNA bases, such as those having sequence "AUCGAUCG" and those having some DNA bases and some RNA bases such as "AUCGATCG" and compounds having other modified nucleobases, such as "AT$^m$CGAUCG," wherein $^m$C indicates a cytosine base comprising a methyl group at the 5-position.

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

Example 1: Design of Gapmers with PS Internucleoside Linkages Complementary to Human MALAT1 RNA Modified oligonucleotides complementary to human a MALAT1 nucleic acid were designed. The modified oligonucleotides in the table below are 3-10-3 cET gapmers. The gapmers are 16 nucleosides in length, wherein the central gap segment comprises of either ten 2'-deoxynucleosides, or of a combination of one 2'-O-methyl nucleoside and nine 2'-deoxynucleosides. The central gap segment is flanked by wing segments on the 5' direction and the 3' direction comprising three nucleosides each. Each nucleoside in the 5' wing segment and each nucleoside in the 3' wing segment has a cEt sugar modification. The internucleoside linkages throughout each gapmer are phosphorothioate (P=S) linkages. Each cytosine residue is a 5-methylcytosine. The sequence and chemical notation column specifies the sequence, including 5-methylcytosines, sugar chemistry, and the internucleoside linkage chemistry; wherein subscript 'd' represents a 2'-β-D-deoxyribosyl sugar moiety, subscript 'k' represents a cET sugar moiety, subscript 's' represents to a phosphorothioate internucleoside linkage, superscript 'm' before the cytosine residue represents a 5-methylcytosine, and subscript 'y' represents a 2'-O-methyl ribose sugar. "Start site" indicates the 5'-most nucleoside to which the gapmer is complementary in the human nucleic acid sequence. "Stop site" indicates the 3'-most nucleoside to which the gapmer is complementary in the human nucleic acid sequence.

Each modified oligonucleotide listed in the table below is complementary to human MALAT1 nucleic acid sequence SEQ ID NO: 1 (GENBANK Accession No: XR_001309.1).

TABLE 1 cET gapmers with PS internucleoside linkages complementary to human MALAT1

| Compound Number | Sequence (5' to 3') | SEQ ID NO: 1 Start Site | SEQ ID NO: 1 Stop Site | Chemistry Notation (5' to 3') | SEQ ID NO |
|---|---|---|---|---|---|
| 1157034 | TTCGGTTTAATCTCTT | 1535 | 1550 | $T_{ks}T_{ks}{}^mC_{ks}G_{ds}G_{ds}T_{ds}T_{ds}T_{ds}A_{ds}A_{ds}T_{ds}{}^mC_{ds}T_{ds}{}^mC_{ks}T_{ks}T_k$ | 2 |
| 1157111 | GGTTACCAATAATTTC | 2034 | 2049 | $G_{ks}G_{ks}T_{ks}T_{ds}A_{ds}{}^mC_{ds}{}^mC_{ds}A_{ds}A_{ds}T_{ds}A_{ds}A_{ds}T_{ds}T_{ks}T_{ks}{}^mC_k$ | 3 |
| 1157190 | TGGTAATTACTCTTGA | 2341 | 2356 | $T_{ks}G_{ks}G_{ks}T_{ds}A_{ds}A_{ds}T_{ds}T_{ds}A_{ds}{}^mC_{ds}T_{ds}{}^mC_{ds}T_{ds}T_{ks}G_{ks}A_k$ | 4 |
| 1157929 | GTAGTAAGAATCTCAG | 4821 | 4836 | $G_{ks}T_{ks}A_{ks}G_{ds}T_{ds}A_{ds}A_{ds}G_{ds}A_{ds}A_{ds}T_{ds}mC_{ds}T_{ds}{}^mC_{ks}A_{ks}G_k$ | 5 |

TABLE 1-continued cET gapmers with PS internucleoside linkages complementary to human MALAT1

| Compound Number | Sequence (5' to 3') | SEQ ID NO: 1 Start Site | SEQ ID NO: 1 Stop Site | Chemistry Notation (5' to 3') | SEQ ID NO |
|---|---|---|---|---|---|
| 1158161 | CCTTAGTTGGCATCAA | 5494 | 5509 | $^{m}C_{ks}{}^{m}C_{ks}T_{ks}T_{ds}A_{ds}G_{ds}T_{ds}T_{ds}G_{ds}G_{ds}{}^{m}C_{ds}A_{ds}T_{ds}{}^{m}C_{ks}A_{ks}A_{k}$ | 6 |
| 1158162 | TCCTTAGTTGGCATCA | 5495 | 5510 | $T_{ks}{}^{m}C_{ks}{}^{m}C_{ks}T_{ds}T_{ds}A_{ds}G_{ds}T_{ds}T_{ds}G_{ds}G_{ds}{}^{m}C_{ds}A_{ds}T_{ks}{}^{m}C_{ks}A_{k}$ | 7 |
| 1304884 | GGATUAATGTAGTGTA | 5049 | 5064 | $G_{ks}G_{ks}A_{ks}T_{ds}U_{ys}A_{ds}A_{ds}T_{ds}G_{ds}T_{ds}A_{ds}G_{ds}T_{ds}G_{ks}T_{ks}A_{k}$ | 8 |
| 1304890 | GGTTATAGCTTGACAA | 4931 | 4946 | $G_{ks}G_{ks}T_{ks}T_{ds}A_{ys}T_{ds}A_{ds}G_{ds}{}^{m}C_{ds}T_{ds}T_{ds}G_{ds}A_{ds}{}^{m}C_{ks}A_{ks}A_{k}$ | 9 |
| 1304906 | GCAGATAATGTTCTCA | 4840 | 4855 | $G_{ks}{}^{m}C_{ks}A_{ks}G_{ds}A_{ys}T_{ds}A_{ds}A_{ds}T_{ds}G_{ds}T_{ds}T_{ds}{}^{m}C_{ds}T_{ks}{}^{m}C_{ks}A_{k}$ | 10 |

Example 2: Antisense Inhibition of Human MALAT1 in A-431 Cells by Modified Oligonucleotides The modified oligonucleotides were tested in a series of experiments that had similar culture conditions. The results for each experiment are presented in a single table shown below. Cultured A-431 cells at a density of 10,000 cells per well were treated using free uptake with 5 nM of modified oligonucleotide. After a treatment period of approximately 48 hours, RNA was isolated from the cells and MALAT1 RNA levels were measured by quantitative real-time RTPCR. Human primer probe set RTS2736 (forward sequence AAAGCAAGGTCTCCCCACAAG, designated herein as SEQ ID NO.: 2814; reverse sequence TGAAGGGTCTGTGCTAGATCAAAA, designated herein as SEQ ID NO.: 2815; probe sequence TGCCACATCGC-CACCCCGT, designated herein as SEQ ID NO.: 2816) was used to measure RNA levels. MALAT1 RNA levels were normalized to total RNA content, as measured by RIBOGREEN®. Results are presented in the tables below as percent control of the amount of MALAT1 RNA relative to untreated control cells (% UTC).

TABLE 2

Inhibition of MALAT1 RNA by 3-10-3 cEt gapmers targeting SEQ ID NO.: 1

| Compound Number | % UTC |
|---|---|
| 1157034 | 25 |
| 1157111 | 11 |
| 1157190 | 19 |
| 1157929 | 20 |
| 1158161 | 18 |
| 1158162 | 24 |

Example 3: Dose-Dependent Inhibition of Human MALAT1 in A-431 Cells by cEt Gapmers Modified oligonucleotides described in the studies above were tested at various doses in A-431 cells. Cultured A-431 cells at a density of 10,000 cells per well were treated using free uptake with modified oligonucleotides diluted to concentrations described in the tables below. After approximately 48 hours, MALAT1 RNA levels were measured as previously described using the Human MALAT1 primer-probe set RTS2736. MALAT1 RNA levels were normalized to total RNA content, as measured by RIBOGREEN®. Results are presented in the tables below as percent control of the amount of MALAT1 RNA relative to untreated control cells (% UTC). IC50s were calculated using a linear regression on a log/linear plot of the data in excel.

TABLE 3

Dose-dependent inhibition of human MALAT1 mRNA expression by modified oligonucleotides in A-431

| Compound Number | % control | | | | IC50 (nM) |
|---|---|---|---|---|---|
| | 0.3 nM | 1.25 nM | 5.0 nM | 20.0 nM | |
| 1157034 | 72 | 57 | 26 | 6 | 1 |
| 1157111 | 108 | 73 | 6 | 7 | 2 |
| 1157190 | 89 | 93 | 58 | 18 | 6 |
| 1157929 | 81 | 76 | 29 | 10 | 2 |
| 1158161 | 83 | 77 | 37 | 9 | 3 |
| 1158162 | 82 | 78 | 32 | 10 | 3 |

Example 4: Dose-Dependent Inhibition of Human MALAT1 in MDA-MB-436 Cells by cEt Gapmers Modified oligonucleotides described in the studies above were tested at various doses in MDA-MB-436 cells. Cultured MDA-MB-436 cells at a density of 5,000-12,000 cells per well were treated using free uptake with modified oligonucleotides diluted to concentrations described in the tables below. After approximately 48 hours, MALAT1 RNA levels were measured as previously described using the Human MALAT1 primer-probe set RTS2736. MALAT1 RNA levels were normalized to b-actin, measured using human primer-probe set HTS5002 (forward sequence CGGACTATGACTTAGTTGCGTTACA, designated herein as SEQ ID NO.: 2817; reverse sequence GCCATGC-CAATCTCATCTTGT, designated herein as SEQ ID NO.: 2818; probe sequence CCTTTCTTGACAAAA-CCTAACTTGCGCAGA, designated herein as SEQ ID NO.: 2819). Results are presented in the tables below as percent control of the amount of MALAT1 RNA relative to untreated control cells (% UTC). Each table below represents a separate experiment. IC50s for table 4 were calculated using the "log(inhibitor) vs. response—variable slope (4 parameters)" formula using Prism6 software. IC50s for tables 5 and 6 were calculated using the "log(inhibitor) vs. response—variable slope (3 parameters)" formula using Prism7 software.

TABLE 4

Dose-dependent inhibition of human MALAT1 RNA expression by modified oligonucleotides in MDA-MB-436 cells

| Compound Number | % control | | | | IC50 (nM) |
|---|---|---|---|---|---|
| | 0.8 nM | 4.0 nM | 20.0 nM | 100.0 nM | |
| 1157034 | 50 | 25 | 17 | 5 | 0.7 |
| 1157111 | 98 | 30 | 13 | 8 | 2.9 |
| 1157190 | 56 | 39 | 15 | 5 | 1.4 |
| 1157929 | 58 | 51 | 33 | 5 | 2.6 |
| 1158161 | 36 | 48 | 27 | 3 | 0.5 |
| 1158162 | 57 | 37 | 22 | 6 | 1.5 |

TABLE 5

Dose-dependent inhibition of human MALAT1 RNA expression by modified oligonucleotides in MDA-MB-436 cells

| Compound Number | % control | | | | IC50 (nM) |
|---|---|---|---|---|---|
| | 8 nM | 40 nM | 200 nM | 1000 nM | |
| 1304906 | 68 | 23 | 6 | 2 | 8 |
| 1304890 | 68 | 20 | 5 | 3 | 5 |
| 1304884 | 68 | 25 | 5 | 2 | 10 |

TABLE 6

Dose-dependent inhibition of human MALAT1 RNA expression by modified oligonucleotides in MDA-MB-436 cells

| Compound Number | % control | | | | IC50 (nM) |
|---|---|---|---|---|---|
| | 0.4 nM | 2 nM | 10 nM | 50 nM | |
| 1304906 | 98 | 88 | 47 | 17 | 9 |
| 1304890 | 109 | 88 | 52 | 17 | 8 |
| 1304884 | 98 | 75 | 55 | 23 | 8 |

Example 5: Tolerability of Modified Oligonucleotides Targeting Human MALAT1 in CD-1 Mice CD-1 mice were treated with modified oligonucleotides selected from studies described above and evaluated for changes in the levels of various plasma chemistry markers.

Treatment

Groups of male CD-1 mice at 4-6 weeks of age (obtained from Charles River) were injected subcutaneously twice a week for four weeks (for a total of 8 treatments) with 50 mg/kg of modified oligonucleotides. One group of male CD-1 mice was injected with PBS. Mice were euthanized 25 days post start of treatment (24 hours post final administration).

Plasma Chemistry Markers

To evaluate the effect of modified oligonucleotides on liver function, plasma levels of alanine aminotransferase (ALT), aspartate aminotransferase (AST), blood urea nitrogen (BUN), total bilirubin (TBIL), and albumin (ALB) were measured using an automated clinical chemistry analyzer (Hitachi Olympus AU400c, Melville, N.Y.). The results are presented in the tables below.

TABLE 7

Plasma chemistry markers in CD-1 mice

| ION NO. | ALT (IU/L) | AST (IU/L) | BUN (mg/dL) | TBIL (mg/dL) | Albumin (g/dL) |
|---|---|---|---|---|---|
| PBS | 20 | 46 | 24 | 0.2 | 2.5 |
| 1157929 | 330 | 225 | 24 | 0.2 | 2.3 |
| 1158161 | 86 | 128 | 29 | 0.2 | 2.3 |

Body and Organ Weights

Body weights of CD-1 mice were measured at the end of the study, and the average body weight for each group is presented in the table below. Kidney, spleen, and liver weights were measured at the end of the study and are presented in the table below.

TABLE 8

Body and organ weights

| ION No. | Body Weight (g) | Liver (g) | Kidney (g) | Spleen (g) |
|---|---|---|---|---|
| PBS | 32 | 1.7 | 0.5 | 0.1 |
| 1157929 | 34 | 2.3 | 0.5 | 0.2 |
| 1158161 | 34 | 2.3 | 0.5 | 0.2 |

Example 6: Tolerability of Modified Oligonucleotides Targeting Human MALAT1 in CD-1 Mice CD-1 mice were treated with modified oligonucleotides selected from studies described above and evaluated for changes in the levels of various plasma chemistry markers.

Treatment

Groups of male CD-1 mice at 4-6 weeks of age (obtained from Charles River) were injected subcutaneously twice a week for four weeks (for a total of 8 treatments) with 50 mg/kg of modified oligonucleotides. One group of male CD-1 mice was injected with PBS. Mice were euthanized 24 days post start of treatment (24 hours post final administration).

Plasma Chemistry Markers

To evaluate the effect of modified oligonucleotides on liver function, plasma levels of alanine aminotransferase (ALT), aspartate aminotransferase (AST), blood urea nitrogen (BUN), and total bilirubin (TBIL), were measured using an automated clinical chemistry analyzer (Hitachi Olympus AU400c, Melville, N.Y.). The results are presented in the tables below.

TABLE 9

Plasma chemistry markers in CD-1 mice

| ION NO. | ALT (IU/L) | AST (IU/L) | BUN (mg/dL) | TBIL (mg/dL) |
|---|---|---|---|---|
| PBS | 43 | 71 | 26 | 0.2 |
| 1157111 | 341 | 200 | 22 | 0.2 |

Body and Organ Weights

Body weights of CD-1 mice were measured at the end of the study, and the average body weight for each group is presented in the table below. Kidney, spleen, and liver weights were measured at the end of the study and are presented in the table below.

TABLE 10

Body and organ weights

| ION No. | Body Weight (g) | Liver (g) | Kidney (g) | Spleen (g) |
|---|---|---|---|---|
| PBS | 37 | 2.0 | 0.6 | 0.1 |
| 1157111 | 38 | 2.8 | 0.5 | 0.2 |

Example 7: Tolerability of Modified Oligonucleotides Targeting Human MALAT1 in CD-1 Mice CD-1 mice were treated with modified oligonucleotides selected from studies described above and evaluated for changes in the levels of various plasma chemistry markers.

Treatment

Groups of male CD-1 mice at 4-6 weeks of age (obtained from Charles River) were injected subcutaneously twice a week for four weeks (for a total of 8 treatments) with 50 mg/kg of modified oligonucleotides. One group of male CD-1 mice was injected with PBS. Mice were euthanized 26 days post start of treatment (24 hours post final administration).

Plasma Chemistry Markers

To evaluate the effect of modified oligonucleotides on liver function, plasma levels of alanine aminotransferase (ALT), aspartate aminotransferase (AST), blood urea nitrogen (BUN), and total bilirubin (TBIL), were measured using an automated clinical chemistry analyzer (Hitachi Olympus AU400c, Melville, N.Y.). The results are presented in the tables below.

TABLE 11

Plasma chemistry markers in CD-1 mice

| ION NO. | ALT (IU/L) | AST (IU/L) | BUN (mg/dL) | TBIL (mg/dL) |
|---|---|---|---|---|
| PBS | 22 | 46 | 22 | 0.3 |
| 1157034 | 608 | 480 | 21 | 0.2 |
| 1157190 | 41 | 83 | 23 | 0.2 |
| 1158162 | 435 | 325 | 24 | 0.2 |

Body and Organ Weights

Body weights of CD-1 mice were measured at the end of the study, and the average body weight for each group is presented in the table below. Kidney, spleen, and liver weights were measured at the end of the study and are presented in the table below.

TABLE 12

Body and organ weights

| ION No. | Body Weight (g) | Liver (g) | Kidney (g) | Spleen (g) |
|---|---|---|---|---|
| PBS | 33 | 1.8 | 0.5 | 0.1 |
| 1157034 | 37 | 2.3 | 0.5 | 0.2 |
| 1157190 | 35 | 1.9 | 0.4 | 0.2 |
| 1158162 | 36 | 2.6 | 0.5 | 0.2 |

Example 8: Tolerability of Modified Oligonucleotides Targeting Human MALAT1 in CD-1 Mice CD-1 mice were treated with modified oligonucleotides selected from studies described above and evaluated for changes in the levels of various plasma chemistry markers.

Treatment

Groups of male CD-1 mice at 4-6 weeks of age (obtained from Charles River) were injected subcutaneously twice a week for four weeks (for a total of 8 treatments) with 50 mg/kg of modified oligonucleotides. One group of male CD-1 mice was injected with PBS. Mice were euthanized 25 days post start of treatment (24 hours following the final administration).

Plasma Chemistry Markers

To evaluate the effect of modified oligonucleotides on liver function, plasma levels of alanine aminotransferase (ALT), aspartate aminotransferase (AST), blood urea nitrogen (BUN), and total bilirubin (TBIL), were measured using an automated clinical chemistry analyzer (Hitachi Olympus AU400c, Melville, N.Y.). The results are presented in the tables below.

TABLE 13

Plasma chemistry markers in CD-1 mice

| ION NO. | ALT (IU/L) | AST (IU/L) | BUN (mg/dL) | TBIL (mg/dL) |
|---|---|---|---|---|
| PBS | 20 | 51 | 21 | 0.2 |
| 1304890 | 33 | 51 | 21 | 0.2 |
| 1304906 | 59 | 78 | 22 | 0.2 |

Body and Organ Weights

Body weights of CD-1 mice were measured at the end of the study, and the average body weight for each group is presented in the table below. Kidney, spleen, and liver weights were measured at the end of the study and are presented in the table below.

TABLE 14

Body and organ weights

| ION No. | Body Weight (g) | Liver (g) | Kidney (g) | Spleen (g) |
|---|---|---|---|---|
| PBS | 32 | 1.6 | 0.5 | 0.1 |
| 1304890 | 36 | 2.0 | 0.5 | 0.2 |
| 1304906 | 34 | 1.8 | 0.5 | 0.1 |

Example 9: Tolerability of Modified Oligonucleotides Targeting Human MALAT1 in CD-1 Mice CD-1 mice were treated with modified oligonucleotides selected from studies described above and evaluated for changes in the levels of various plasma chemistry markers.

Treatment

Groups of male CD-1 mice at 4-6 weeks of age (obtained from Charles River) were injected subcutaneously twice a week for four weeks (for a total of 8 treatments) with 50 mg/kg of modified oligonucleotides. One group of male CD-1 mice was injected with PBS. Mice were euthanized 25 days post start of treatment (24 hours following the final administration).

Plasma Chemistry Markers

To evaluate the effect of modified oligonucleotides on liver function, plasma levels of alanine aminotransferase (ALT), aspartate aminotransferase (AST), blood urea nitrogen (BUN), and total bilirubin (TBIL), were measured using an automated clinical chemistry analyzer (Hitachi Olympus AU400c, Melville, N.Y.). The results are presented in the tables below.

TABLE 15

Plasma chemistry markers in CD-1 mice

| ION NO. | ALT (IU/L) | AST (IU/L) | BUN (mg/dL) | TBIL (mg/dL) |
|---|---|---|---|---|
| PBS | 19 | 56 | 16 | 0.2 |
| 1304884 | 33 | 55 | 15 | 0.1 |

Body and Organ Weights

Body weights of CD-1 mice were measured at the end of the study, and the average body weight for each group is presented in the table below. Kidney, spleen, and liver weights were measured at the end of the study and are presented in the table below.

TABLE 16

Body and organ weights

| ION No. | Body Weight (g) | Liver (g) | Kidney (g) | Spleen (g) |
|---|---|---|---|---|
| PBS | 34 | 2.0 | 0.5 | 0.1 |
| 1304884 | 37 | 2.2 | 0.5 | 0.2 |

Example 10: Effect of Modified Oligonucleotides Targeting Human MALAT1 in Cynomolgus Monkeys Cynomolgus monkeys were treated with certain Ionis modified oligonucleotides selected from studies described in the Examples above. Modified oligonucleotide tolerability was evaluated.

Study 1

Treatment

Prior to the study, the monkeys were kept in quarantine during which the animals were observed daily for general health. The monkeys were 2-4 years old and weighed 2-4 kg. Seven groups of 4 randomly assigned male cynomolgus monkeys each were injected subcutaneously with Ionis oligonucleotide or saline in a clockwise rotation between four different sites on the back. Following loading doses on days 1, 3, 5 and 7, the monkeys were dosed once per week for 6 weeks (on days 14, 21, 28, 35, and 41) with 35 mg/kg of Ionis oligonucleotide. A control group of 4 cynomolgus monkeys was injected with 0.9% saline in a similar manner and served as the control group.

During the study period, the monkeys were observed at least once daily for signs of illness or distress. Any animal experiencing illness or distress was promptly reported to the veterinarian and Study Director. Any animal in poor health or in a possible moribund condition was identified for further monitoring and possible euthanasia Scheduled euthanasia of the animals was conducted on day 43 approximately 48 hours after the last dose by exsanguination while under deep anesthesia. The protocols described in the Example were approved by the Institutional Animal Care and Use Committee (IACUC).

Body and Organ Weight Measurements

To evaluate the effect of modified oligonucleotides on the overall health of the animals, body and organ weights were measured. Terminal body weight was measured prior to necropsy. Organ weights were measured as well.

TABLE 17

Body and organ weights (g)

| Compound No. | Body Weight (g) Day 43 | Heart | kidney | spleen | liver |
|---|---|---|---|---|---|
| Saline | 2565 | 10 | 12 | 3 | 49 |
| 1157034 | 2748 | 10 | 16 | 5 | 67 |
| 1157111 | 2524 | 9 | 13 | 3 | 62 |
| 1157190 | 2663 | 10 | 15 | 5 | 63 |
| 1157929 | 2655 | 10 | 14 | 3 | 59 |
| 1158161 | 2418 | 9 | 14 | 3 | 53 |
| 1158162 | 2499 | 9 | 18 | 3 | 55 |

Kidney and Liver Function

To evaluate the effect of modified oligonucleotides on hepatic and kidney function, blood samples were collected from all the study groups on day 43. The monkeys were fasted overnight prior to blood collection. Blood was collected in tubes without anticoagulant for serum separation. The tubes were kept at room temperature for a minimum of 90 minutes and then centrifuged at 3000 rpm for 10 minutes to obtain serum. Levels of various liver function markers were measured using a Toshiba 120FR NEO chemistry analyzer (Toshiba Co., Japan). Plasma levels of blood urea nitrogen (BUN), creatinine (CREA), total protein (TP), alanine aminotransferase (ALT), aspartate aminotransferase (AST), and total bilirubin (TBIL) were measured.

TABLE 18

Liver function markers in cynomolgus monkey plasma

| Compound No. | ALT (IU/L) | AST (IU/L) | BUN (mg/dL) | CREA (mg/dL) | TP (g/dL) | TBIL (mg/dL) |
|---|---|---|---|---|---|---|
| Saline | 49 | 59 | 21 | 0.9 | 7.3 | 0.3 |
| 1157034 | 40 | 55 | 18 | 0.8 | 6.8 | 0.2 |
| 1157111 | 41 | 72 | 23 | 0.8 | 7.1 | 0.3 |
| 1157190 | 59 | 67 | 21 | 0.9 | 7.1 | 0.3 |
| 1157929 | 63 | 71 | 21 | 0.9 | 7.1 | 0.2 |
| 1158161 | 58 | 59 | 18 | 0.8 | 7.3 | 0.3 |
| 1158162 | 53 | 81 | 17 | 0.8 | 7.5 | 0.3 |

Pro-Inflammatory Proteins Analysis

To evaluate any inflammatory effect of modified oligonucleotides in cynomolgus monkeys, blood samples were taken for analysis. The monkeys were fasted overnight prior to blood collection. On day 41 (pre-dose and 24 hours post-dose), approximately 0.8 mL of blood was collected from each animal and put into tubes without anticoagulant for serum separation. The tubes were kept at room temperature for a minimum of 90 min and then centrifuged at 3,000 rpm for 10 min at room temperature to obtain serum. Complement C3 were measured using a Toshiba 120 FR NEO chemistry analyzer (Toshiba Co., Japan). Another marker of inflammation, C-Reactive Protein (CRP) was tested together with the clinical chemistry parameters tested for liver function above.

TABLE 19

Pro-inflammatory protein analysis in cynomolgus monkeys

| Compound No. | Complement C3 (mg/dL) Day 41 (pre-dose) | Complement C3 (mg/dL) Day 41 (24 hr post-dose) | CRP (mg/L) day 43 |
|---|---|---|---|
| Saline | 95 | 92 | 5 |
| 1157034 | 115 | 100 | 3 |
| 1157111 | 105 | 87 | 9 |

TABLE 19-continued

Pro-inflammatory protein analysis in cynomolgus monkeys

| Compound No. | Complement C3 (mg/dL) | | CRP (mg/L) day 43 |
|---|---|---|---|
| | Day 41 (pre-dose) | Day 41 (24 hr post-dose) | |
| 1157190 | 106 | 90 | 4 |
| 1157929 | 115 | 105 | 7 |
| 1158161 | 107 | 99 | 5 |
| 1158162 | 111 | 100 | 6 |

Hematology

To evaluate any effect of modified oligonucleotides in cynomolgus monkeys on hematologic parameters, blood samples of approximately 0.5 mL of blood was collected from each of the available study animals on day 43. The samples were collected in tubes containing $K_2$-EDTA. Samples were analyzed for red blood cell (RBC) count, Hemoglobin (HGB), Hematocrit (HCT), platelet count (PLT), total white blood cell count (WBC), neutrophil counts (NEU), lymphocyte counts (LYM), and monocyte counts (MON) using an ADVIA2120i hematology analyzer (Siemens, USA).

TABLE 20

Hematological marker analysis in cynomolgus monkeys

| Compound No. | RBC (×106/μL) | HGB (g/dL) | HCT (%) | PLT ($10^3$/μL) | WBC (×$10^3$/μL) | NEU (%) | LYM (%) | MON (%) |
|---|---|---|---|---|---|---|---|---|
| Saline | 5 | 12 | 43 | 320 | 8 | 47 | 49 | 3 |
| 1157034 | 6 | 13 | 45 | 329 | 11 | 34 | 61 | 4 |
| 1157111 | 5 | 13 | 43 | 419 | 13 | 50 | 45 | 3 |
| 1157190 | 6 | 13 | 44 | 383 | 10 | 38 | 56 | 4 |
| 1157929 | 6 | 13 | 45 | 309 | 8 | 37 | 57 | 3 |
| 1158161 | 6 | 13 | 43 | 332 | 11 | 31 | 63 | 3 |
| 1158162 | 5 | 12 | 43 | 453 | 9 | 41 | 52 | 5 |

Urine Analysis

Food was removed overnight the day before fresh urine collection, but water was supplied. Fresh urine samples for urinalysis and urine chemistry were collected from all animals using a clean cage pan on wet ice (first in the morning) on day 43. Urinalysis/Urine Chemistry parameters creatinine (UCRE), microprotein (UTP), urine microalbumin (UALB), and protein/creatinine (P/C) ratio were measured using a Toshiba 120FR automated chemistry analyzer (Toshiba Co., Japan).

TABLE 21

Urine analysis in cynomolgus monkeys

| Compound No. | UCRE (mg/dL) | UTP (mg/dL) | UALB (mg/dL) | P/C ratio |
|---|---|---|---|---|
| Saline | 98 | 14 | 0.75 | 0.15 |
| 1157034 | 44 | 16 | 0.34 | 0.39 |
| 1157111 | 46 | 13 | 0.30 | 0.29 |
| 1157190 | 64 | 17 | 0.29 | 0.28 |
| 1157929 | 83 | 13 | 0.56 | 0.17 |
| 1158161 | 111 | 18 | 0.70 | 0.17 |
| 1158162 | 45 | 26 | 5.10 | 0.65 |

Study 2
Treatment

Prior to the study, the monkeys were kept in quarantine during which the animals were observed daily for general health. The monkeys were 2-4 years old and weighed 2-4 kg. Four groups of 4 randomly assigned male cynomolgus monkeys each were injected subcutaneously with Ionis oligonucleotide or saline in a clockwise rotation between four different sites on the back. Following loading doses on days 1, 3, 5 and 7, the monkeys were dosed once per week for 6 weeks (on days 14, 21, 28, 35, and 41) with 35 mg/kg of Ionis oligonucleotide. A control group of 4 cynomolgus monkeys was injected with 0.9% saline in a similar manner and served as the control group.

During the study period, the monkeys were observed at least once daily for signs of illness or distress. Any animal experiencing illness or distress was promptly reported to the veterinarian and Study Director. Any animal in poor health or in a possible moribund condition was identified for further monitoring and possible euthanasia Scheduled euthanasia of the animals was conducted on day 43 approximately 48 hours after the last dose by exsanguination while under deep anesthesia. The protocols described in the Example were approved by the Institutional Animal Care and Use Committee (IACUC).

Body and Organ Weight Measurements

To evaluate the effect of modified oligonucleotides on the overall health of the animals, body and organ weights were measured. Terminal body weight was measured prior to necropsy. Organ weights were measured as well.

TABLE 22

Body and organ weights (g)

| Compound No. | Body Weight (g) Day 43 | Heart | kidney | spleen | liver |
|---|---|---|---|---|---|
| Saline | 2843 | 9 | 12 | 3 | 57 |
| 1304884 | 2643 | 9 | 14 | 4 | 65 |
| 1304890 | 2788 | 9 | 14 | 3 | 61 |
| 1304906 | 2678 | 10 | 13 | 3 | 60 |

Kidney and Liver Function

To evaluate the effect of modified oligonucleotides on hepatic and kidney function, blood samples were collected from all the study groups on day 43. The monkeys were fasted overnight prior to blood collection. Blood was collected in tubes without anticoagulant for serum separation. The tubes were kept at room temperature for a minimum of 90 minutes and then centrifuged at 3000 rpm for 10 minutes to obtain serum. Levels of various liver function markers were measured using a Toshiba 120FR NEO chemistry analyzer (Toshiba Co., Japan). Plasma levels of blood urea nitrogen (BUN), creatinine (CREA), total protein (TP), alanine aminotransferase (ALT), aspartate aminotransferase (AST), and total bilirubin (TBIL) were measured.

TABLE 23

Liver function markers in cynomolgus monkey plasma

| Compound No. | ALT (IU/L) | AST (IU/L) | BUN (mg/dL) | CREA (mg/dL) | TP (g/dL) | TBIL (mg/dL) |
|---|---|---|---|---|---|---|
| Saline | 52 | 74 | 28 | 1.0 | 7.0 | 0.3 |
| 1304884 | 64 | 47 | 23 | 0.9 | 7.0 | 0.2 |
| 1304890 | 52 | 62 | 25 | 0.9 | 7.0 | 0.2 |
| 1304906 | 75 | 73 | 24 | 0.9 | 7.2 | 0.3 |

Pro-Inflammatory Proteins Analysis

To evaluate any inflammatory effect of modified oligonucleotides in cynomolgus monkeys, blood samples were taken for analysis. The monkeys were fasted overnight prior to blood collection. On day 41 (pre-dose and 24 hours post-dose), approximately 0.8 mL of blood was collected from each animal and put into tubes without anticoagulant for serum separation. The tubes were kept at room temperature for a minimum of 90 min and then centrifuged at 3,000 rpm for 10 min at room temperature to obtain serum. Complement C3 were measured using a Toshiba 120 FR NEO chemistry analyzer (Toshiba Co., Japan). Another marker of inflammation, C-Reactive Protein (CRP) was tested together with the clinical chemistry parameters tested for liver function above.

TABLE 24

Pro-inflammatory protein analysis in cynomolgus monkeys

| Compound No. | Complement C3 (mg/dL) | | CRP (mg/L) day 43 |
|---|---|---|---|
| | Day 43 (pre-dose) | Day 43 (24 hr post-dose) | |
| Saline | 127 | 127 | 5 |
| 1304884 | 112 | 98 | 3 |
| 1304890 | 102 | 98 | 3 |
| 1304906 | 108 | 88 | 3 |

Hematology

To evaluate any effect of modified oligonucleotides in cynomolgus monkeys on hematologic parameters, blood samples of approximately 0.5 mL of blood was collected from each of the available study animals on day 43. The samples were collected in tubes containing $K_2$-EDTA. Samples were analyzed for red blood cell (RBC) count, Hemoglobin (HGB), Hematocrit (HCT), platelet count (PLT), total white blood cell count (WBC), neutrophil counts (NEU), lymphocyte counts (LYM), and monocyte counts (MON) using an ADVIA2120i hematology analyzer (Siemens, USA).

TABLE 25

Hematological marker analysis in cynomolgus monkeys

| Compound No. | RBC (×10⁶/μL) | HGB (g/dL) | HCT (%) | PLT (10³/μL) | WBC (×10³/μL) | NEU (%) | LYM (%) | MON (%) |
|---|---|---|---|---|---|---|---|---|
| Saline | 5 | 12 | 43 | 352 | 12 | 29 | 64 | 3 |
| 1304884 | 5 | 13 | 41 | 386 | 9 | 30 | 62 | 3 |
| 1304890 | 5 | 13 | 42 | 460 | 12 | 33 | 62 | 2 |
| 1304906 | 6 | 13 | 42 | 413 | 13 | 48 | 46 | 4 |

Urine Analysis

Food was removed overnight the day before fresh urine collection, but water was supplied. Fresh urine samples for urinalysis and urine chemistry were collected from all animals using a clean cage pan on wet ice (first in the morning) on day 43. Urinalysis/Urine Chemistry parameters creatinine (UCRE), microprotein (UTP), urine microalbumin (UALB), and protein/creatinine (P/C) ratio were measured using a Toshiba 120FR automated chemistry analyzer (Toshiba Co., Japan).

TABLE 26

Urine analysis in cynomolgus monkeys

| Compound No. | UCRE (mg/dL) | UTP (mg/dL) | UALB (mg/dL) | P/C ratio |
|---|---|---|---|---|
| Saline | 73 | 10 | 0.5 | 0.1 |
| 1304884 | 45 | 12 | 0.7 | 0.3 |
| 1304890 | 81 | 15 | 0.9 | 0.2 |
| 1304906 | 70 | 11 | 0.5 | 0.2 |

Example 11: Dose-Dependent Inhibition of Human MALAT1 in A431 Cells by Comparator Compounds Certain modified oligonucleotides described in the art were tested at various doses in A431 cells and used as comparator compounds in other Examples below. The following modified oligonucleotides described in the art were compared: 395240, 395243, 395244, 395248, 395251, 395252, 395253, 395254, 395255, 395256, 395257, 395259, 395267, 395269, 395272, 395275, 395280, 395283, 395287, 395290, 556089, 559497, and 626112. The chemical notation column in the table below specifies the sequence and chemistry information, including 5-methylcytosines, sugar chemistry, and the internucleoside linkage chemistry; wherein subscript 'd' represents a 2'β-D-deoxyribosyl sugar moiety, subscript 'k' represents a cET sugar moiety, subscript 'e' represents a 2'-MOE sugar moiety, subscript, 's' represents to a phosphorothioate internucleoside linkage, superscript 'm' before the cytosine residue represents a 5-methylcytosine, and subscript 'o' represents a phosphodiester internucleoside linkage. "Start site" indicates the 5'-most nucleoside to which the gapmer is complementary in the human nucleic acid sequence. "Stop site" indicates the 3'-most nucleoside to which the gapmer is complementary in the human nucleic acid sequence. Each modified oligonucleotide listed in the table below is complementary to human MALAT1 nucleic acid sequence SEQ ID NO: 1 (GENBANK Accession No: XR_001309.1).

TABLE 27

Certain Comparator Compounds

| Compound Number | SEQ ID NO: 1 Start Site | SEQ ID NO: 1 Stop Site | Sequence (5' to 3') | Chemistry Notation (5' to 3') | Reference Number | SEQ ID No. |
|---|---|---|---|---|---|---|
| 395240 | 3320 | 3339 | TGCCTTTAGGATTCTAGACA | $T_{es}G_{es}{}^mC_{es}{}^mC_{es}T_{es}T_{ds}T_{ds}A_{ds}G_{ds}G_{ds}A_{ds}T_{ds}T_{ds}{}^mC_{ds}T_{ds}A_{es}G_{es}A_{es}{}^mC_{es}A_e$ | WO 2012/012467 | 11 |
| 395243 | 3885 | 3904 | TAATTGCCAATATTTGCCCC | $T_{es}A_{es}A_{es}T_{es}T_{es}G_{ds}{}^mC_{ds}{}^mC_{ds}A_{ds}A_{ds}T_{ds}A_{ds}T_{ds}T_{ds}T_{ds}G_{es}{}^mC_{es}{}^mC_{es}{}^mC_{es}{}^mC_e$ | WO 2012/012467 | 12 |
| 395244 | 4036 | 4055 | GGGAGTTACTTGCCAACTTG | $G_{es}G_{es}G_{es}A_{es}G_{es}T_{ds}T_{ds}A_{ds}{}^mC_{ds}T_{ds}T_{ds}G_{ds}{}^mC_{ds}{}^mC_{ds}A_{ds}A_{es}{}^mC_{es}T_{es}T_{es}G_e$ | WO 2012/012467 | 13 |
| 395248 | 4493 | 4512 | TTGCAGTTAAACAATGGAAA | $T_{es}T_{es}G_{es}{}^mC_{es}A_{es}G_{ds}T_{ds}T_{ds}A_{ds}A_{ds}A_{ds}{}^mC_{ds}A_{ds}A_{ds}T_{ds}G_{es}G_{es}A_{es}A_{es}A_e$ | WO 2012/012467 | 14 |
| 395251 | 4698 | 4717 | CCAGGCTGGTTATGACTCAG | ${}^mC_{es}{}^mC_{es}A_{es}G_{es}G_{es}{}^mC_{ds}T_{ds}G_{ds}G_{ds}T_{ds}T_{ds}A_{ds}T_{ds}G_{ds}A_{ds}{}^mC_{es}T_{es}{}^mC_{es}A_{es}G_e$ | WO 2012/012467 | 15 |
| 395252 | 4748 | 4767 | TTATCAATTCACCAAGGAGC | $T_{es}T_{es}A_{es}T_{es}{}^mC_{es}A_{ds}A_{ds}T_{ds}T_{ds}{}^mC_{ds}A_{ds}{}^mC_{ds}{}^mC_{ds}A_{ds}A_{ds}G_{es}G_{es}A_{es}G_{es}{}^mC_e$ | WO 2012/012467 | 16 |
| 395253 | 4783 | 4802 | ATGGAGGTATGACATATAAT | $A_{es}T_{es}G_{es}G_{es}A_{es}G_{ds}G_{ds}T_{ds}A_{ds}T_{ds}G_{ds}A_{ds}{}^mC_{ds}A_{ds}T_{ds}A_{es}T_{es}A_{es}A_{es}T_e$ | WO 2012/012467 | 17 |
| 395254 | 4843 | 4862 | GGCATATGCAGATAATGTTC | $G_{es}G_{es}{}^mC_{es}A_{es}T_{es}A_{ds}T_{ds}G_{ds}{}^mC_{ds}A_{ds}G_{ds}A_{ds}T_{ds}A_{ds}A_{ds}T_{es}G_{es}T_{es}T_{es}{}^mC_e$ | WO 2012/012467 | 18 |
| 395255 | 5123 | 5142 | ACATTGGCACACAGCACAGC | $A_{es}{}^mC_{es}A_{es}T_{es}T_{es}G_{ds}G_{ds}{}^mC_{ds}A_{ds}{}^mC_{ds}A_{ds}{}^mC_{ds}A_{ds}G_{ds}{}^mC_{ds}A_{es}{}^mC_{es}A_{es}G_{es}{}^mC_e$ | WO 2012/012467 | 19 |
| 395256 | 5134 | 5153 | AGGCAAACGAAACATTGGCA | $A_{es}G_{es}G_{es}{}^mC_{es}A_{es}A_{ds}A_{ds}{}^mC_{ds}G_{ds}A_{ds}A_{ds}A_{ds}{}^mC_{ds}A_{ds}T_{ds}T_{es}G_{es}G_{es}{}^mC_{es}A_e$ | WO 2012/012467 | 20 |
| 395257 | 5248 | 5267 | CTAACATGCAATACTGCAGA | ${}^mC_{es}T_{es}A_{es}A_{es}{}^mC_{es}A_{ds}T_{ds}G_{ds}{}^mC_{ds}A_{ds}A_{ds}T_{ds}A_{ds}{}^mC_{ds}T_{ds}G_{es}{}^mC_{es}A_{es}G_{es}A_e$ | WO 2012/012467 | 21 |
| 395259 | 5393 | 5412 | AAGCCCACAGGAACAAGTCC | $A_{es}A_{es}G_{es}{}^mC_{es}{}^mC_{es}{}^mC_{ds}A_{ds}{}^mC_{ds}A_{ds}G_{ds}G_{ds}A_{ds}A_{ds}{}^mC_{ds}A_{ds}A_{es}G_{es}T_{es}{}^mC_{es}{}^mC_e$ | WO 2012/012467 | 22 |
| 395267 | 6098 | 6117 | GGTCAATAGTGTAAAACATT | $G_{es}G_{es}T_{es}{}^mC_{es}A_{es}A_{ds}T_{ds}A_{ds}G_{ds}T_{ds}G_{ds}T_{ds}A_{ds}A_{ds}A_{ds}A_{es}{}^mC_{es}A_{es}T_{es}T_e$ | WO 2012/012467 | 23 |
| 395269 | 6174 | 6193 | TTCATGAAGGATGAAATGCC | $T_{es}T_{es}{}^mC_{es}A_{es}T_{es}G_{ds}A_{ds}A_{ds}G_{ds}G_{ds}A_{ds}T_{ds}G_{ds}A_{ds}A_{ds}A_{es}T_{es}G_{es}{}^mC_{es}{}^mC_e$ | WO 2012/012467 | 24 |
| 395272 | 6445 | 6464 | CAATGCATTCTAATAGCAGC | ${}^mC_{es}A_{es}A_{es}T_{es}G_{es}{}^mC_{ds}A_{ds}T_{ds}T_{ds}{}^mC_{ds}T_{ds}A_{ds}A_{ds}T_{ds}A_{ds}G_{es}{}^mC_{es}A_{es}G_{es}{}^mC_e$ | WO 2012/012467 | 25 |
| 395275 | 6759 | 6778 | AACATTTCCACTTGCCAGTT | $A_{es}A_{es}{}^mC_{es}A_{es}T_{es}T_{ds}T_{ds}{}^mC_{ds}{}^mC_{ds}A_{ds}{}^mC_{ds}T_{ds}T_{ds}G_{ds}{}^mC_{ds}{}^mC_{es}A_{es}G_{es}T_{es}T_e$ | WO 2012/012467 | 26 |
| 395280 | 6958 | 6977 | GGTTCCCAATCCCCACATTT | $G_{es}G_{es}T_{es}T_{es}{}^mC_{es}{}^mC_{ds}{}^mC_{ds}A_{ds}A_{ds}T_{ds}{}^mC_{ds}{}^mC_{ds}{}^mC_{ds}{}^mC_{ds}A_{ds}{}^mC_{es}A_{es}T_{es}T_{es}T_e$ | WO 2012/012467 | 27 |
| 395283 | 7335 | 7354 | TAATAAAATCAGGTGAGGC | $T_{es}A_{es}A_{es}T_{es}A_{es}A_{ds}A_{ds}A_{ds}A_{ds}T_{ds}{}^mC_{ds}A_{ds}G_{ds}G_{ds}T_{ds}G_{es}A_{es}G_{es}G_{es}{}^mC_e$ | WO 2012/012467 | 28 |
| 395287 | 7878 | 7897 | TCCCACCCAGCATTACAGTT | $T_{es}{}^mC_{es}{}^mC_{es}{}^mC_{es}A_{es}{}^mC_{ds}{}^mC_{ds}{}^mC_{ds}A_{ds}G_{ds}{}^mC_{ds}A_{ds}T_{ds}T_{ds}A_{ds}{}^mC_{es}A_{es}G_{es}T_{es}T_e$ | WO 2012/012467 | 29 |
| 395290 | 8007 | 8026 | TAAGATGCTAGCTTGGCCAA | $T_{es}A_{es}A_{es}G_{es}A_{es}T_{ds}G_{ds}{}^mC_{ds}T_{ds}A_{ds}G_{ds}{}^mC_{ds}T_{ds}T_{ds}G_{ds}G_{es}{}^mC_{es}{}^mC_{es}A_{es}A_e$ | WO 2012/012467 | 30 |
| 556089 | 6445 | 6460 | GCATTCTAATAGCAGC | $G_{ks}{}^mC_{ks}A_{ks}T_{ds}T_{ds}{}^mC_{ds}T_{ds}A_{ds}A_{ds}T_{ds}A_{ds}G_{ds}{}^mC_{ds}A_{ks}G_{ks}{}^mC_k$ | WO 2017/192820; St-Pierre et al., Bioorg Med Chem. 2016; 24(11): 2397-409 | 31 |
| 559497 | 3629 | 3644 | AGTACTATAGCATCTG | $A_{ks}G_{ks}T_{ks}A_{ds}{}^mC_{ds}T_{ds}A_{ds}T_{ds}A_{ds}G_{ds}{}^mC_{ds}A_{ds}T_{ds}{}^mC_{ks}T_{ks}G_k$ | Hung et al., Nucleic Acid Ther. 2013; 23(6): 369-78. | 32 |

TABLE 27-continued

Certain Comparator Compounds

| Compound Number | SEQ ID NO: 1 Start Site | SEQ ID NO: 1 Stop Site | Sequence (5' to 3') | Chemistry Notation (5' to 3') | Reference Number | SEQ ID No. |
|---|---|---|---|---|---|---|
| 626112 | 4699 | 4718 | GCCAGGCTGG TTATGACTCA | $G_{es}{}^mC_{eo}{}^mC_{eo}A_{eo}G_{eo}G_{ds}{}^mC_{ds}T_{ds}G_{ds}G_{ds} T_{ds}T_{ds}A_{ds}T_{ds}G_{ds}A_{eo}{}^mC_{eo}T_{es}{}^mC_{es}A_e$ | WO 2016/073828 | 33 |

Compounds 1058667 and 1058668 have been described in the art. The chemical notation column in the table below specifies the sequence and chemistry information of certain comparator compounds, including 5-methylcytosines, sugar chemistry, and the internucleoside linkage chemistry; wherein subscript 'd' represents a 2'β-D-deoxyribosyl sugar moiety, subscript 'l' represents an LNA sugar moiety, subscript 's' represents to a phosphorothioate internucleoside linkage, and superscript 'm' before the cytosine residue represents a 5-methylcytosine. Compounds 1058667 and 1058668 are complementary to mouse MALAT1 nucleic acid sequence and mismatched with human MALAT1 nucleic acid sequence. "Start site" indicates the 5'-most nucleoside to which the gapmer is complementary in the mouse nucleic acid sequence. "Stop site" indicates the 3'-most nucleoside to which the gapmer is complementary in the mouse nucleic acid sequence. Each modified oligonucleotide listed in the table below is complementary to mouse MALAT1 nucleic acid sequence SEQ ID NO: 2823 (complement of GENBANK Accession No: NC_000085.6 truncated from nucleotides 5793001 to 5806000)

TABLE 28

Certain Comparator Compounds

| Compound Number | SEQ ID NO: 2823 Start Site | SEQ ID NO: 2823 Stop Site | Sequence (5' to 3') | Chemistry Notation (5' to 3') | Reference Number | SEQ ID No. |
|---|---|---|---|---|---|---|
| 1058668 | 8368 | 8383 | GTCACAAT GCATTCTA | $G_{ls}T_{ls}{}^mC_{ls}A_{ds}{}^mC_{ds}A_{ds}A_{ds}T_{ds} G_{ds}{}^mC_{ds}A_{ds}T_{ds}T_{ds}{}^mC_{ls}T_{ls}A_l$ | Michalik et al., Circ Res. 2014; 114(9): 1389-97 and WO 2019/161364 | 34 |
| 1058667 | 6043 | 6061 | TTTAAGTT CTCTGGTA TGA | $T_{ls}T_{ls}T_{ls}A_{ds}A_{ds}G_{ds}T_{ds}T_{ds} {}^mC_{ds}T_{ds}{}^mC_{ds}T_{ds}G_{ds}G_{ds}T_{ds}A_{ds} T_{ls}G_{ls}A_l$ | Bernard et al. EMBO J 2010 29(18): 3082-93 | 35 |

The modified oligonucleotides below were tested in a series of experiments using the same culture conditions. The results for each experiment are presented in separate tables shown below. Cultured A431 cells at a density of 10,000 cells per well were transfected using free uptake with modified oligonucleotides diluted to different concentrations as specified in the tables below. After a treatment period of approximately 48 hours, RNA levels were measured as previously described using the Human primer-probe set RTS2738 (described herein above). MALAT1 RNA levels were normalized to total RNA, as measured by RIBOGREEN®. Results are presented as percent change of MALAT1 RNA, relative to PBS control.

The half maximal inhibitory concentration ($IC_{50}$) of each modified oligonucleotide was calculated using a linear regression on a log/linear plot of the data in excel and is also presented in the tables below.

TABLE 29

Dose-dependent percent reduction of human MALAT1 RNA in A431 cells by modified oligonucleotides

| Compound Number | MALAT1 (% UTC) | | | | | |
|---|---|---|---|---|---|---|
| | 0.4 nM | 2 nM | 10 nM | 50 nM | 250 nM | $IC_{50}$ nM |
| 395240 | 98 | 72 | 37 | 10 | 4 | 7 |
| 395243 | 97 | 101 | 101 | 48 | 10 | 46 |
| 395244 | 91 | 84 | 58 | 12 | 7 | 10 |
| 395248 | 92 | 97 | 49 | 20 | 6 | 12 |
| 395255 | 126 | 121 | 88 | 35 | 13 | 39 |
| 395256 | 111 | 108 | 77 | 19 | 4 | 21 |
| 395257 | 80 | 94 | 74 | 40 | 16 | 26 |
| 395259 | 121 | 97 | 101 | 52 | 23 | 68 |
| 395280 | 103 | 115 | 73 | 32 | 14 | 29 |
| 395283 | 107 | 89 | 84 | 25 | 10 | 23 |
| 395287 | 93 | 78 | 63 | 51 | 31 | 41 |

TABLE 29-continued

Dose-dependent percent reduction of human MALAT1 RNA in A431 cells by modified oligonucleotides

| Compound Number | MALAT1 (% UTC) | | | | | |
|---|---|---|---|---|---|---|
| | 0.4 nM | 2 nM | 10 nM | 50 nM | 250 nM | $IC_{50}$ nM |
| 395290 | 113 | 90 | 101 | 34 | 18 | 40 |
| 626112 | 92 | 93 | 76 | 34 | 14 | 24 |

TABLE 30

Dose-dependent percent reduction of human MALAT1 RNA in A431 cells by modified oligonucleotides

| Compound Number | MALAT1 (% UTC) | | | | | |
|---|---|---|---|---|---|---|
| | 0.4 nM | 2 nM | 10 nM | 50 nM | 250 nM | IC$_{50}$ nM |
| 395251 | 103 | 88 | 54 | 11 | 4 | 11 |
| 395252 | 100 | 117 | 68 | 22 | 6 | 20 |
| 395253 | 110 | 87 | 73 | 14 | 4 | 15 |
| 395254 | 106 | 73 | 32 | 10 | 5 | 7 |
| 395267 | 143 | 126 | 71 | 22 | 6 | 27 |
| 395269 | 97 | 112 | 123 | 61 | 26 | 168 |
| 395272 | 89 | 87 | 78 | 68 | 19 | 63 |
| 395275 | 83 | 81 | 69 | 29 | 14 | 16 |
| 556089 | 106 | 107 | 79 | 37 | 11 | 30 |
| 559497 | 88 | 102 | 59 | 23 | 6 | 14 |
| 1058667 | 131 | 118 | 99 | 30 | 11 | 39 |
| 1058668 | 105 | 95 | 74 | 27 | 7 | 20 |

Example 12: Antisense Inhibition of Human MALAT1 in A431 Cells by 3-10-3 cEt Gapmers Modified oligonucleotides complementary to a MALAT1 nucleic acid were synthesized and tested for their effect on MALAT1 RNA levels in vitro in comparison with comparator compounds 395240, 395253, 395254, 395256, 556089, and 559497 described above. The modified oligonucleotides were tested in a series of experiments using the same culture conditions. The results for each separate experiment are presented in separate tables below.

Except for the comparator compounds 395240, 395253, 395254, and 395256, which are 5-10-5 MOE gapmers (i.e., they have a central gap segment of ten 2'-deoxynucleosides flanked on each side by wing segments, each comprising five 2'-O-methoxyethyl modified nucleosides), the modified oligonucleotides are all 3-10-3 cEt gapmers (i.e., they have a central gap segment of ten 2'-deoxynucleosides flanked on each side by wing segments, each comprising three cEt modified nucleosides). The internucleoside linkages throughout each modified oligonucleotide are phosphorothioate (P=S) linkages. All cytosine nucleobases throughout each modified oligonucleotide are 5-methylcytosines.

"Start site" indicates the 5'-most nucleoside of the target sequence to which the modified oligonucleotide is complementary. "Stop site" indicates the 3'-most nucleoside of the target sequence to which the modified oligonucleotide is complementary. As shown in the tables below, the modified oligonucleotides are 100% complementary to either the human MALAT1 RNA transcript, designated herein as SEQ ID NO: 1 (GENBANK Accession No. XR_001309.1) or the human MALAT1 RNA transcript designated here in as SEQ ID NO: 2824 (GENBANK Accession No. EF177381.1). 'N/A' indicates that the modified oligonucleotide is not complementary to that particular target sequence with 100% complementarity.

Cultured A431 cells at a density of 10,000 cells per well were transfected using free uptake with 5 nM of modified oligonucleotide. After a treatment period of 48 hours, RNA was isolated from the cells and MALAT1 RNA levels were measured by quantitative real-time RTPCR. Human MALAT1 primer probe set RTS2736 (described herein above) was used to measure RNA levels. MALAT1 RNA levels were normalized to total RNA content, as measured by RIBOGREEN®. Results are presented as percent change of MALAT1 RNA, relative to PBS control (% UTC). The symbol "‡" indicates that the modified oligonucleotide is complementary to the target transcript within the amplicon region of the primer probe set, and so the associated data is not reliable. In such instances, additional assays using alternative primer probes must be performed to accurately assess the potency and efficacy of such modified oligonucleotides. In some cases, % UTC values are not available. This is indicated as N.D. (Not Defined) and additional assays will be performed to accurately assess the potency and efficacy of such modified oligonucleotides.

Modified oligonucleotides marked with a triple asterisk (✱) have been previously described in Example 1. The % UTC data for modified oligonucleotides marked with a triple asterisk (✱) in the tables below is identical to the data described in Example 2 as the data is from the same experiments.

TABLE 31

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395240 | 3320 | 3339 | 3520 | 3539 | TGCCTTTAGGATTCTAGACA | 61 | 11 |
| 395253 | 4783 | 4802 | 4982 | 5001 | ATGGAGGTATGACATATAAT | 78 | 17 |
| 395254 | 4843 | 4862 | 5042 | 5061 | GGCATATGCAGATAATGTTC | 61 | 18 |
| 395256 | 5134 | 5153 | 5333 | 5352 | AGGCAAACGAAACATTGGCA | 97 | 20 |
| 556089 | 6445 | 6460 | 6644 | 6659 | GCATTCTAATAGCAGC | 90 | 31 |
| 559497 | 3629 | 3644 | 3829 | 3844 | AGTACTATAGCATCTG | 124 | 32 |
| 559564 | 2839 | 2854 | 3039 | 3054 | CCATAAGTAAGTTCCA | 42 | 36 |
| 1156449 | 11 | 26 | N/A | N/A | CGGGCTGCAGGCTGCG | 86 | 37 |
| 1156482 | 157 | 172 | 123 | 138 | ACCTGGGCTCCCGGAG | 81 | 38 |
| 1156515 | 252 | 267 | 218 | 233 | GGTTTTATCTAAATAC | 75 | 39 |

TABLE 31-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1156549 | 348 | 363 | 314 | 329 | CCTGGTTAGGTATGAG | 81 | 40 |
| 1156583 | 483 | 498 | 449 | 464 | GACCAACTAAGCGAAT | 61 | 41 |
| 1156617 | 529 | 544 | 495 | 510 | AAGGCAAATCGCCATG | 86 | 42 |
| 1156651 | 598 | 613 | 564 | 579 | GCCCCCCACGGCCCGC | 90 | 43 |
| 1156685 | 720 | 735 | 686 | 701 | CGTGAAAACCCACTCT | 106 | 44 |
| 1156718 | 829 | 844 | 795 | 810 | CCCCAACTGCTTGCAG | 87 | 45 |
| 1156752 | 892 | 907 | 858 | 873 | TTACGCAACTGAGCCC | 89 | 46 |
| 1156786 | 957 | 972 | 923 | 938 | GTAGGTATAGTTTACC | 61 | 47 |
| 1156820 | N/A | N/A | 1006 | 1021 | AAACGGGTCATCAAAC | 81 | 48 |
| 1156854 | N/A | N/A | 1119 | 1134 | ACAGCTTATGGAACTT | 73 | 49 |
| 1156888 | 1015 | 1030 | 1215 | 1230 | GGAATTCGATCACCTT | 71 | 50 |
| 1156922 | 1068 | 1083 | 1268 | 1283 | ACCGCACAGCTCGGGC | 95 | 51 |
| 1156956 | 1172 | 1187 | 1372 | 1387 | TGTATTAATCTCTATC | 59 | 52 |
| 1156990 | 1331 | 1346 | 1531 | 1546 | ACCTCCGTCATGTTTT | 57 | 53 |
| 1157023 | 1513 | 1528 | 1713 | 1728 | AGATCGCCTTCAAATT | 59 | 54 |
| 1157057 | 1588 | 1603 | 1788 | 1803 | TTTAAATGACGCAATT | 85 | 55 |
| 1157090 | 1846 | 1861 | 2046 | 2061 | TGCCCTTAGCTTTTG | 44 | 56 |
| 1157124 | 2094 | 2109 | 2294 | 2309 | GCTTTACCTTCTAACT | 31 | 57 |
| 1157158 | 2278 | 2293 | 2478 | 2493 | GCTACTATATTTAAGG | 71 | 58 |
| 1157190 ※ | 2341 | 2356 | 2541 | 2556 | TGGTAATTACTCTTGA | 19 | 4 |
| 1157224 | 2434 | 2449 | 2634 | 2649 | TCTGTGTAGCACCTGG | 37 | 59 |
| 1157258 | 2546 | 2561 | 2746 | 2761 | TATCTTCACCACGAAC | 100 | 60 |
| 1157292 | 2671 | 2686 | 2871 | 2886 | CATCACCAAATTGCAC | 72 | 61 |
| 1157325 | 2744 | 2759 | 2944 | 2959 | GTCTAGGATCCTCTAC | 86 | 62 |
| 1157359 | 2814 | 2829 | 3014 | 3029 | CATATTGCCGACCTCA | 57 | 63 |
| 1157393 | 2893 | 2908 | 3093 | 3108 | TTTACACCTCAGTACG | 65 | 64 |
| 1157426 | 2971 | 2986 | 3171 | 3186 | ACAAGATTCATGAGTA | 73 | 65 |
| 1157458 | 3122 | 3137 | 3322 | 3337 | CATACAAACTGCTTAC | 71 | 66 |
| 1157492 | 3234 | 3249 | 3434 | 3449 | CCCCGCCTCAGTTACA | 65 | 67 |
| 1157525 | 3335 | 3350 | 3535 | 3550 | CTTGAGTCATTTGCCT | 35 | 68 |
| 1157559 | 3447 | 3462 | 3647 | 3662 | ATGGACATCTCTTCCA | 70 | 69 |
| 1157591 | 3628 | 3643 | 3828 | 3843 | GTACTATAGCATCTGT | 55 | 70 |
| 1157624 | 3697 | 3712 | 3897 | 3912 | TCCAGTCCCTGAAGGT | 88 | 71 |
| 1157658 | 3824 | 3839 | 4024 | 4039 | AACTTCAACATTTGGC | 44 | 72 |
| 1157691 | 3941 | 3956 | 4141 | 4156 | CAATTACCTAAACCCA | 80 | 73 |
| 1157725 | 4050 | 4065 | 4250 | 4265 | CTAAATCATTGGGAGT | 52 | 74 |

TABLE 31-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157758 | 4184 | 4199 | 4384 | 4399 | GCTCTATACTTTGAAG | 49 | 75 |
| 1157791 | 4274 | 4289 | 4474 | 4489 | CCAAACAACTTTTGCA | 56 | 76 |
| 1157825 | 4428 | 4443 | 4628 | 4643 | TAGAATCTTACTTGAT | 66 | 77 |
| 1157858 | 4614 | 4629 | 4813 | 4828 | CCTCTAAGAGACATTC | 71 | 78 |
| 1157890 | 4747 | 4762 | 4946 | 4961 | AATTCACCAAGGAGCT | 65 | 79 |
| 1157924 | 4815 | 4830 | 5014 | 5029 | AGAATCTCAGGGTTAT | 36 | 80 |
| 1157958 | 4903 | 4918 | 5102 | 5117 | AAAATGGTAGATTCCG | 19 | 81 |
| 1157992 | 5050 | 5065 | 5249 | 5264 | AGGATTAATGTAGTGT | 13 | 82 |
| 1158025 | 5137 | 5152 | 5336 | 5351 | GGCAAACGAAACATTG | 65 | 83 |
| 1158058 | 5220 | 5235 | 5419 | 5434 | TTATCTGTTAACAGCT | 69 | 84 |
| 1158091 | 5286 | 5301 | 5485 | 5500 | GAACTCCACAGCTCTT | 67 | 85 |
| 1158123 | 5388 | 5403 | 5587 | 5602 | GGAACAAGTCCTACAA | 77 | 86 |
| 1158156 | 5487 | 5502 | 5686 | 5701 | TGGCATCAAGGCACTG | 51 | 87 |
| 1158190 | 5577 | 5592 | 5776 | 5791 | TTTTAGCAGTAACATC | 66 | 88 |
| 1158223 | 5773 | 5788 | 5972 | 5987 | AGTGTTCGCAGACAAA | 66 | 89 |
| 1158256 | 5896 | 5911 | 6095 | 6110 | GCCTCTATTGCCATGT | 70 | 90 |
| 1158289 | 5993 | 6008 | 6192 | 6207 | AGACCCTGACTTTCT | 78 | 91 |
| 1158323 | 6081 | 6096 | 6280 | 6295 | CCTACCACTCTAAGAT | 73 | 92 |
| 1158357 | 6195 | 6210 | 6394 | 6409 | TCAAAATCCTGAATGG | 62 | 93 |
| 1158390 | 6324 | 6339 | 6523 | 6538 | AGTAAGCCCCACCCCC | 71 | 94 |
| 1158423 | 6436 | 6451 | 6635 | 6650 | TAGCAGCGGGATCAGA | 68 | 95 |
| 1158455 | 6537 | 6552 | 6736 | 6751 | CTTTATCACTCAGCTG | 63 | 96 |
| 1158488 | 6695 | 6710 | 6894 | 6909 | TTTAAGGTTGCATCTG | 59 | 97 |
| 1158519 | 6968 | 6983 | 7167 | 7182 | ACTAGTGGTTCCCAAT | 67 | 98 |
| 1158552 | 7062 | 7077 | 7261 | 7276 | CAGAAAAGCTTGTTC | 63 | 99 |
| 1158586 | 7159 | 7174 | 7358 | 7373 | GCCAACACAGTTTGCT | 70 | 100 |
| 1158618 | 7306 | 7321 | 7505 | 7520 | GACCTTAGGATAATAG | 20 | 101 |
| 1158652 | 7399 | 7414 | 7598 | 7613 | TCAAGCATTCCTTCGG | 27 | 102 |
| 1158685 | 7522 | 7537 | 7721 | 7736 | AAAAGTGGTTGCCCGC | 72 | 103 |
| 1158719 | 7654 | 7669 | 7853 | 7868 | TCCAAGCTACTGGCTG | 80 | 104 |
| 1158753 | 7708 | 7723 | 7907 | 7922 | AGACCTCGACACCATC | 54 | 105 |
| 1158785 | 7775 | 7790 | 7974 | 7989 | TAATACCCTTCTGTTA | 81 | 106 |
| 1158819 | 7872 | 7887 | 8071 | 8086 | CATTACAGTTCTTGAA | 59 | 107 |
| 1158852 | 7949 | 7964 | 8148 | 8163 | GCATTCCCACCCAAAA | 66 | 108 |
| 1158885 | 8040 | 8055 | 8239 | 8254 | ACTGAAGAGCATTGGA | 66 | 109 |
| 1158916 | 8196 | 8211 | 8395 | 8410 | CGCCGCAGGGATTTGA | 81 | 110 |

TABLE 31-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158950 | 8328 | 8343 | 8527 | 8542 | CAAGGATGTATATAGT | 100 | 111 |
| 1158984‡ | 8424 | 8439 | 8623 | 8638 | CTGCAGGCTATTACCT | 106 | 112 |

TABLE 32

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395240 | 3320 | 3339 | 3520 | 3539 | TGCCTTTAGGATTCTAGACA | 49 | 11 |
| 395253 | 4783 | 4802 | 4982 | 5001 | ATGGAGGTATGACATATAAT | 75 | 17 |
| 395254 | 4843 | 4862 | 5042 | 5061 | GGCATATGCAGATAATGTTC | 49 | 18 |
| 395256 | 5134 | 5153 | 5333 | 5352 | AGGCAAACGAAACATTGGCA | 88 | 20 |
| 556089 | 6445 | 6460 | 6644 | 6659 | GCATTCTAATAGCAGC | 79 | 31 |
| 559497 | 3629 | 3644 | 3829 | 3844 | AGTACTATAGCATCTG | 117 | 32 |
| 559564 | 2839 | 2854 | 3039 | 3054 | CCATAAGTAAGTTCCA | 27 | 36 |
| 946417 | 6325 | 6340 | 6524 | 6539 | AAGTAAGCCCCACCCC | 63 | 113 |
| 946420 | 7160 | 7175 | 7359 | 7374 | CGCCAACACAGTTTGC | 88 | 114 |
| 1156450 | 13 | 28 | N/A | N/A | CTCGGGCTGCAGGCTG | 81 | 115 |
| 1156483 | 158 | 173 | 124 | 139 | AACCTGGGCTCCCGGA | 70 | 116 |
| 1156516 | 256 | 271 | 222 | 237 | GAGTGGTTTTATCTAA | 69 | 117 |
| 1156550 | 349 | 364 | 315 | 330 | GCCTGGTTAGGTATGA | 79 | 118 |
| 1156584 | 484 | 499 | 450 | 465 | AGACCAACTAAGCGAA | 62 | 119 |
| 1156618 | 530 | 545 | 496 | 511 | CAAGGCAAATCGCCAT | 58 | 120 |
| 1156652 | 599 | 614 | 565 | 580 | AGCCCCCACGGCCCG | 73 | 121 |
| 1156686 | 734 | 749 | 700 | 715 | GGAAATCTTAGAAACG | 64 | 122 |
| 1156719 | 830 | 845 | 796 | 811 | CCCCCAACTGCTTGCA | 71 | 123 |
| 1156753 | 893 | 908 | 859 | 874 | ATTACGCAACTGAGCC | 84 | 124 |
| 1156787 | 958 | 973 | 924 | 939 | AGTAGGTATAGTTTAC | 90 | 125 |
| 1156821 | N/A | N/A | 1007 | 1022 | TAAACGGGTCATCAAA | 66 | 126 |
| 1156855 | N/A | N/A | 1123 | 1138 | CTTAACAGCTTATGGA | 70 | 127 |
| 1156889 | 1016 | 1031 | 1216 | 1231 | CGGAATTCGATCACCT | 81 | 128 |
| 1156923 | 1069 | 1084 | 1269 | 1284 | TACCGCACAGCTCGGG | 80 | 129 |
| 1156957 | 1174 | 1189 | 1374 | 1389 | GTTGTATTAATCTCTA | 24 | 130 |
| 1156991 | 1333 | 1348 | 1533 | 1548 | CAACCTCCGTCATGTT | 65 | 131 |
| 1157024 | 1514 | 1529 | 1714 | 1729 | AAGATCGCCTTCAAAT | 51 | 132 |
| 1157058 | 1589 | 1604 | 1789 | 1804 | CTTTAAATGACGCAAT | 65 | 133 |

TABLE 32-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157091 | 1851 | 1866 | 2051 | 2066 | CATTTTGCCCTTAGCT | 46 | 134 |
| 1157125 | 2095 | 2110 | 2295 | 2310 | AGCTTTACCTTCTAAC | 53 | 135 |
| 1157159 | 2283 | 2298 | 2483 | 2498 | ACTAAGCTACTATATT | 61 | 136 |
| 1157191 | 2342 | 2357 | 2542 | 2557 | TTGGTAATTACTCTTG | 32 | 137 |
| 1157225 | 2441 | 2456 | 2641 | 2656 | ATCCACTTCTGTGTAG | 62 | 138 |
| 1157259 | 2547 | 2562 | 2747 | 2762 | CTATCTTCACCACGAA | 60 | 139 |
| 1157293 | 2676 | 2691 | 2876 | 2891 | ACCTTCATCACCAAAT | 78 | 140 |
| 1157326 | 2745 | 2760 | 2945 | 2960 | GGTCTAGGATCCTCTA | 77 | 141 |
| 1157360 | 2815 | 2830 | 3015 | 3030 | ACATATTGCCGACCTC | 57 | 142 |
| 1157394 | 2894 | 2909 | 3094 | 3109 | CTTTACACCTCAGTAC | 62 | 143 |
| 1157427 | 2972 | 2987 | 3172 | 3187 | GACAAGATTCATGAGT | 53 | 144 |
| 1157459 | 3133 | 3148 | 3333 | 3348 | CCCCAACTAAACATAC | 74 | 145 |
| 1157493 | 3235 | 3250 | 3435 | 3450 | CCCCCGCCTCAGTTAC | 72 | 146 |
| 1157526 | 3337 | 3352 | 3537 | 3552 | ACCTTGAGTCATTTGC | 34 | 147 |
| 1157560 | 3448 | 3463 | 3648 | 3663 | AATGGACATCTCTTCC | 73 | 148 |
| 1157592 | 3630 | 3645 | 3830 | 3845 | TAGTACTATAGCATCT | 51 | 149 |
| 1157625 | 3709 | 3724 | 3909 | 3924 | GATAAAGCAGCTCCA | 70 | 150 |
| 1157659 | 3837 | 3852 | 4037 | 4052 | TATTGGAAAACTTAAC | 74 | 151 |
| 1157692 | 3942 | 3957 | 4142 | 4157 | ACAATTACCTAAACCC | 67 | 152 |
| 1157726 | 4051 | 4066 | 4251 | 4266 | ACTAAATCATTGGGAG | 41 | 153 |
| 1157759 | 4185 | 4200 | 4385 | 4400 | AGCTCTATACTTTGAA | 36 | 154 |
| 1157792 | 4282 | 4297 | 4482 | 4497 | TACCATATCCAAACAA | 89 | 155 |
| 1157826 | 4429 | 4444 | 4629 | 4644 | ATAGAATCTTACTTGA | 34 | 156 |
| 1157859 | 4615 | 4630 | 4814 | 4829 | CCCTCTAAGAGACATT | 68 | 157 |
| 1157891 | 4751 | 4766 | 4950 | 4965 | TATCAATTCACCAAGG | 99 | 158 |
| 1157925 | 4817 | 4832 | 5016 | 5031 | TAAGAATCTCAGGGTT | 31 | 159 |
| 1157959 | 4904 | 4919 | 5103 | 5118 | TAAAATGGTAGATTCC | 12 | 160 |
| 1157993 | 5051 | 5066 | 5250 | 5265 | CAGGATTAATGTAGTG | 15 | 161 |
| 1158026 | 5138 | 5153 | 5337 | 5352 | AGGCAAACGAAACATT | 65 | 162 |
| 1158059 | 5221 | 5236 | 5420 | 5435 | CTTATCTGTTAACAGC | 57 | 163 |
| 1158092 | 5289 | 5304 | 5488 | 5503 | TAAGAACTCCACAGCT | 59 | 164 |
| 1158124 | 5389 | 5404 | 5588 | 5603 | AGGAACAAGTCCTACA | 64 | 165 |
| 1158157 | 5488 | 5503 | 5687 | 5702 | TTGGCATCAAGGCACT | 28 | 166 |
| 1158191 | 5600 | 5615 | 5799 | 5814 | CAATTTACATCACAAC | 55 | 167 |
| 1158224 | 5775 | 5790 | 5974 | 5989 | AGAGTGTTCGCAGACA | 43 | 168 |
| 1158257 | 5900 | 5915 | 6099 | 6114 | GAGGGCCTCTATTGCC | 86 | 169 |

TABLE 32-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158290 | 5995 | 6010 | 6194 | 6209 | ATAGACCCCTGACTTT | 66 | 170 |
| 1158324 | 6082 | 6097 | 6281 | 6296 | GCCTACCACTCTAAGA | 71 | 171 |
| 1158358 | 6200 | 6215 | 6399 | 6414 | GCAATTCAAAATCCTG | 49 | 172 |
| 1158424 | 6437 | 6452 | 6636 | 6651 | ATAGCAGCGGGATCAG | 43 | 173 |
| 1158456 | 6538 | 6553 | 6737 | 6752 | CCTTTATCACTCAGCT | 46 | 174 |
| 1158489 | 6697 | 6712 | 6896 | 6911 | ATTTTAAGGTTGCATC | 63 | 175 |
| 1158520 | 6970 | 6985 | 7169 | 7184 | GAACTAGTGGTTCCCA | 54 | 176 |
| 1158553 | 7081 | 7096 | 7280 | 7295 | CTGACTTTGTATGTAA | 49 | 177 |
| 1158619 | 7307 | 7322 | 7506 | 7521 | TGACCTTAGGATAATA | 38 | 178 |
| 1158653 | 7400 | 7415 | 7599 | 7614 | TTCAAGCATTCCTTCG | 38 | 179 |
| 1158686 | 7523 | 7538 | 7722 | 7737 | GAAAAGTGGTTGCCCG | 68 | 180 |
| 1158720 | 7655 | 7670 | 7854 | 7869 | ATCCAAGCTACTGGCT | 60 | 181 |
| 1158754 | 7709 | 7724 | 7908 | 7923 | AAGACCTCGACACCAT | 56 | 182 |
| 1158786 | 7780 | 7795 | 7979 | 7994 | GGTTTTAATACCCTTC | 49 | 183 |
| 1158820 | 7873 | 7888 | 8072 | 8087 | GCATTACAGTTCTTGA | 28 | 184 |
| 1158853 | 7968 | 7983 | 8167 | 8182 | GTCTTAGCAGAGAATT | 53 | 185 |
| 1158886 | 8041 | 8056 | 8240 | 8255 | TACTGAAGAGCATTGG | 29 | 186 |
| 1158917 | 8210 | 8225 | 8409 | 8424 | AGTCAAAGCAAAGACG | 65 | 187 |
| 1158951 | 8329 | 8344 | 8528 | 8543 | TCAAGGATGTATATAG | 94 | 188 |
| 1158985 | 8426 | 8441 | 8625 | 8640 | AGCTGCAGGCTATTAC | 61 | 189 |

Example 13: Antisense Inhibition of Human MALAT1 in A431 Cells by 3-10-3 cEt Gapmers Modified oligonucleotides complementary to a MALAT1 nucleic acid were synthesized and tested for their effect on MALAT1 RNA levels in vitro in comparison with comparator compounds 395254 and 559497 described above. The modified oligonucleotides were tested in a series of experiments using the same culture conditions. The results for each separate experiment are presented in separate tables below.

Except for the comparator compound 395254, which is a 5-10-5 MOE gapmer (i.e., it has a central gap segment of ten 2'-deoxynucleosides flanked on each side by wing segments, each comprising five 2'-O-methoxyethyl modified nucleosides), the modified oligonucleotides are all 3-10-3 cEt gapmers (i.e., they have a central gap segment of ten 2'-deoxynucleosides flanked on each side by wing segments, each comprising three cEt modified nucleosides). The internucleoside linkages throughout each modified oligonucleotide are phosphorothioate (P=S) linkages. All cytosine nucleobases throughout each modified oligonucleotide are 5-methylcytosines.

"Start site" indicates the 5'-most nucleoside of the target sequence to which the modified oligonucleotide is complementary. "Stop site" indicates the 3'-most nucleoside of the target sequence to which the modified oligonucleotide is complementary. As shown in the tables below, the modified oligonucleotides are 100% complementary to either the human MALAT1 RNA transcript, designated herein as SEQ ID NO: 1 (GENBANK Accession No. XR_001309.1) or the human MALAT1 RNA transcript designated here in as SEQ ID NO: 2824 (GENBANK Accession No. EF177381.1). 'N/A' indicates that the modified oligonucleotide is not complementary to that particular target sequence with 100% complementarity.

TABLE 33

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 107 | 18 |
| 559497 | 3629 | 3644 | 3829 | 3844 | AGTACTATAGCATCTG | 130 | 32 |
| 559564 | 2839 | 2854 | 3039 | 3054 | CCATAAGTAAGTTCCA | 38 | 36 |
| 568439 | 1590 | 1605 | 1790 | 1805 | GCTTTAAATGACGCAA | 122 | 190 |
| 1156451 | 14 | 29 | N/A | N/A | TCTCGGGCTGCAGGCT | 80 | 191 |
| 1156484 | 159 | 174 | 125 | 140 | AAACCTGGGCTCCCGG | 80 | 192 |
| 1156517 | 257 | 272 | 223 | 238 | TGAGTGGTTTTATCTA | 93 | 193 |
| 1156551 | 354 | 369 | 320 | 335 | GTTATGCCTGGTTAGG | 84 | 194 |
| 1156585 | 485 | 500 | 451 | 466 | TAGACCAACTAAGCGA | 109 | 195 |
| 1156619 | 531 | 546 | 497 | 512 | ACAAGGCAAATCGCCA | 83 | 196 |
| 1156653 | 603 | 618 | 569 | 584 | CGCCAGCCCCCACGG | 145 | 197 |
| 1156687 | 738 | 753 | 704 | 719 | CTTGGGAAATCTTAGA | 111 | 198 |
| 1156720 | 831 | 846 | 797 | 812 | TCCCCCAACTGCTTGC | 89 | 199 |
| 1156754 | 894 | 909 | 860 | 875 | CATTACGCAACTGAGC | 101 | 200 |
| 1156788 | 959 | 974 | 925 | 940 | CAGTAGGTATAGTTTA | 117 | 201 |
| 1156822 | N/A | N/A | 1008 | 1023 | TTAAACGGGTCATCAA | 100 | 202 |
| 1156856 | N/A | N/A | 1124 | 1139 | TCTTAACAGCTTATGG | 69 | 203 |
| 1156890 | 1017 | 1032 | 1217 | 1232 | CCGGAATTCGATCACC | 91 | 204 |
| 1156924 | 1071 | 1086 | 1271 | 1286 | CCTACCGCACAGCTCG | 97 | 205 |
| 1156958 | 1176 | 1191 | 1376 | 1391 | TAGTTGTATTAATCTC | 62 | 206 |
| 1156992 | 1334 | 1349 | 1534 | 1549 | TCAACCTCCGTCATGT | 68 | 207 |
| 1157025 | 1515 | 1530 | 1715 | 1730 | AAAGATCGCCTTCAAA | 68 | 208 |
| 1157092 | 1853 | 1868 | 2053 | 2068 | TACATTTTGCCCTTAG | 30 | 209 |
| 1157126 | 2117 | 2132 | 2317 | 2332 | CGTAAACACCCTCATC | 68 | 210 |
| 1157160 | 2284 | 2299 | 2484 | 2499 | AACTAAGCTACTATAT | 102 | 211 |
| 1157192 | 2344 | 2359 | 2544 | 2559 | AGTTGGTAATTACTCT | 60 | 212 |
| 1157226 | 2446 | 2461 | 2646 | 2661 | ACTGAATCCACTTCTG | 65 | 213 |
| 1157260 | 2548 | 2563 | 2748 | 2763 | CCTATCTTCACCACGA | 94 | 214 |
| 1157294 | 2678 | 2693 | 2878 | 2893 | CTACCTTCATCACCAA | 98 | 215 |
| 1157327 | 2746 | 2761 | 2946 | 2961 | TGGTCTAGGATCCTCT | 115 | 216 |
| 1157361 | 2816 | 2831 | 3016 | 3031 | AACATATTGCCGACCT | 55 | 217 |
| 1157395 | 2895 | 2910 | 3095 | 3110 | CCTTTACACCTCAGTA | 87 | 218 |
| 1157428 | 2973 | 2988 | 3173 | 3188 | AGACAAGATTCATGAG | 50 | 219 |
| 1157460 | 3134 | 3149 | 3334 | 3349 | ACCCCAACTAAACATA | 74 | 220 |
| 1157494 | 3236 | 3251 | 3436 | 3451 | CCCCCCGCCTCAGTTA | 107 | 221 |
| 1157527 | 3338 | 3353 | 3538 | 3553 | CACCTTGAGTCATTTG | 63 | 222 |

TABLE 33-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157561 | 3449 | 3464 | 3649 | 3664 | CAATGGACATCTCTTC | 51 | 223 |
| 1157593 | 3631 | 3646 | 3831 | 3846 | ATAGTACTATAGCATC | 70 | 224 |
| 1157626 | 3710 | 3725 | 3910 | 3925 | GGATAAAAGCAGCTCC | 68 | 225 |
| 1157660 | 3872 | 3887 | 4072 | 4087 | CCCTCCCCTTTAATAA | 117 | 226 |
| 1157693 | 3943 | 3958 | 4143 | 4158 | AACAATTACCTAAACC | 84 | 227 |
| 1157727 | 4052 | 4067 | 4252 | 4267 | AACTAAATCATTGGGA | 101 | 228 |
| 1157760 | 4190 | 4205 | 4390 | 4405 | CCAAAAGCTCTATACT | 88 | 229 |
| 1157793 | 4283 | 4298 | 4483 | 4498 | CTACCATATCCAAACA | 79 | 230 |
| 1157827 | 4447 | 4462 | 4647 | 4662 | GCTTACACACAACTGA | 50 | 231 |
| 1157860 | 4616 | 4631 | 4815 | 4830 | ACCCTCTAAGAGACAT | 65 | 232 |
| 1157892 | 4752 | 4767 | 4951 | 4966 | TTATCAATTCACCAAG | 75 | 233 |
| 1157926 | 4818 | 4833 | 5017 | 5032 | GTAAGAATCTCAGGGT | 22 | 234 |
| 1157960 | 4920 | 4935 | 5119 | 5134 | GACAAGCAATTAACTT | 34 | 235 |
| 1157994 | 5052 | 5067 | 5251 | 5266 | CCAGGATTAATGTAGT | 29 | 236 |
| 1158027 | 5139 | 5154 | 5338 | 5353 | GAGGCAAACGAAACAT | 99 | 237 |
| 1158060 | 5222 | 5237 | 5421 | 5436 | ACTTATCTGTTAACAG | 75 | 238 |
| 1158093 | 5290 | 5305 | 5489 | 5504 | TTAAGAACTCCACAGC | 54 | 239 |
| 1158125 | 5390 | 5405 | 5589 | 5604 | CAGGAACAAGTCCTAC | 81 | 240 |
| 1158158 | 5491 | 5506 | 5690 | 5705 | TAGTTGGCATCAAGGC | 28 | 241 |
| 1158192 | 5605 | 5620 | 5804 | 5819 | CTACACAATTTACATC | 78 | 242 |
| 1158225 | 5777 | 5792 | 5976 | 5991 | AAAGAGTGTTCGCAGA | 46 | 243 |
| 1158258 | 5901 | 5916 | 6100 | 6115 | AGAGGGCCTCTATTGC | 67 | 244 |
| 1158291 | 5996 | 6011 | 6195 | 6210 | TATAGACCCCTGACTT | 58 | 245 |
| 1158325 | 6083 | 6098 | 6282 | 6297 | TGCCTACCACTCTAAG | 110 | 246 |
| 1158359 | 6208 | 6223 | 6407 | 6422 | ACTCATATGCAATTCA | 39 | 247 |
| 1158391 | 6326 | 6341 | 6525 | 6540 | CAAGTAAGCCCCACCC | 74 | 248 |
| 1158425 | 6438 | 6453 | 6637 | 6652 | AATAGCAGCGGGATCA | 66 | 249 |
| 1158457 | 6539 | 6554 | 6738 | 6753 | GCCTTTATCACTCAGC | 71 | 250 |
| 1158490 | 6698 | 6713 | 6897 | 6912 | GATTTTAAGGTTGCAT | 45 | 251 |
| 1158521 | 6971 | 6986 | 7170 | 7185 | AGAACTAGTGGTTCCC | 103 | 252 |
| 1158554 | 7082 | 7097 | 7281 | 7296 | TCTGACTTTGTATGTA | 52 | 253 |
| 1158587 | 7161 | 7176 | 7360 | 7375 | ACGCCAACACAGTTTG | 52 | 254 |
| 1158620 | 7308 | 7323 | 7507 | 7522 | TTGACCTTAGGATAAT | 53 | 255 |
| 1158654 | 7405 | 7420 | 7604 | 7619 | GGTACTTCAAGCATTC | 56 | 256 |
| 1158687 | 7524 | 7539 | 7723 | 7738 | GGAAAAGTGGTTGCCC | 76 | 257 |
| 1158721 | 7656 | 7671 | 7855 | 7870 | GATCCAAGCTACTGGC | 82 | 258 |

TABLE 33-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158755 | 7710 | 7725 | 7909 | 7924 | AAAGACCTCGACACCA | 85 | 259 |
| 1158787 | 7781 | 7796 | 7980 | 7995 | TGGTTTTAATACCCTT | 89 | 260 |
| 1158821 | 7874 | 7889 | 8073 | 8088 | AGCATTACAGTTCTTG | 22 | 261 |
| 1158854 | 7977 | 7992 | 8176 | 8191 | CCTGAAAAAGTCTTAG | 72 | 262 |
| 1158887 | 8042 | 8057 | 8241 | 8256 | CTACTGAAGAGCATTG | 78 | 263 |
| 1158918 | 8216 | 8231 | 8415 | 8430 | ATTAGTAGTCAAAGCA | 80 | 264 |
| 1158952 | 8330 | 8345 | 8529 | 8544 | ATCAAGGATGTATATA | 100 | 265 |
| 1158986 | 8445 | 8460 | 8644 | 8659 | TAGGGCTTCTCAAAAC | 96 | 266 |

TABLE 34

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 96 | 18 |
| 556064 | 5140 | 5155 | 5339 | 5354 | TGAGGCAAACGAAACA | 84 | 267 |
| 559497 | 3629 | 3644 | 3829 | 3844 | AGTACTATAGCATCTG | 123 | 32 |
| 559564 | 2839 | 2854 | 3039 | 3054 | CCATAAGTAAGTTCCA | 33 | 36 |
| 1156452 | 15 | 30 | N/A | N/A | GTCTCGGGCTGCAGGC | 106 | 268 |
| 1156485 | 160 | 175 | 126 | 141 | GAAACCTGGGCTCCCG | 87 | 269 |
| 1156518 | 262 | 277 | 228 | 243 | GAGTTTGAGTGGTTTT | 74 | 270 |
| 1156552 | 356 | 371 | 322 | 337 | GTGTTATGCCTGGTTA | 98 | 271 |
| 1156586 | 486 | 501 | 452 | 467 | GTAGACCAACTAAGCG | 74 | 272 |
| 1156620 | 532 | 547 | 498 | 513 | CACAAGGCAAATCGCC | 80 | 273 |
| 1156654 | 610 | 625 | 576 | 591 | CAGTTGCCGCCAGCCC | 103 | 274 |
| 1156688 | 739 | 754 | 705 | 720 | GCTTGGGAAATCTTAG | 93 | 275 |
| 1156721 | 832 | 847 | 798 | 813 | CTCCCCCAACTGCTTG | 78 | 276 |
| 1156755 | 895 | 910 | 861 | 876 | CCATTACGCAACTGAG | 88 | 277 |
| 1156789 | 960 | 975 | 926 | 941 | ACAGTAGGTATAGTTT | 76 | 278 |
| 1156823 | N/A | N/A | 1009 | 1024 | TTTAAACGGGTCATCA | 90 | 279 |
| 1156857 | N/A | N/A | 1125 | 1140 | TTCTTAACAGCTTATG | 79 | 280 |
| 1156891 | 1018 | 1033 | 1218 | 1233 | ACCGGAATTCGATCAC | 65 | 281 |
| 1156925 | 1072 | 1087 | 1272 | 1287 | GCCTACCGCACAGCTC | 74 | 282 |
| 1156959 | 1177 | 1192 | 1377 | 1392 | GTAGTTGTATTAATCT | 32 | 283 |
| 1156993 | 1335 | 1350 | 1535 | 1550 | CTCAACCTCCGTCATG | 41 | 284 |
| 1157026 | 1516 | 1531 | 1716 | 1731 | AAAAGATCGCCTTCAA | 66 | 285 |

TABLE 34-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157059 | 1591 | 1606 | 1791 | 1806 | GGCTTTAAATGACGCA | 83 | 286 |
| 1157093 | 1854 | 1869 | 2054 | 2069 | GTACATTTTGCCCTTA | 36 | 287 |
| 1157127 | 2133 | 2148 | 2333 | 2348 | AATTGGTTCTGGTCTA | 42 | 288 |
| 1157161 | 2285 | 2300 | 2485 | 2500 | AAACTAAGCTACTATA | 117 | 289 |
| 1157193 | 2345 | 2360 | 2545 | 2560 | AAGTTGGTAATTACTC | 78 | 290 |
| 1157227 | 2451 | 2466 | 2651 | 2666 | GATTCACTGAATCCAC | 92 | 291 |
| 1157261 | 2549 | 2564 | 2749 | 2764 | TCCTATCTTCACCACG | 60 | 292 |
| 1157295 | 2681 | 2696 | 2881 | 2896 | CTGCTACCTTCATCAC | 61 | 293 |
| 1157328 | 2755 | 2770 | 2955 | 2970 | CTGGCATGCTGGTCTA | 81 | 294 |
| 1157362 | 2817 | 2832 | 3017 | 3032 | CAACATATTGCCGACC | 126 | 295 |
| 1157396 | 2896 | 2911 | 3096 | 3111 | CCCTTTACACCTCAGT | 75 | 296 |
| 1157429 | 2974 | 2989 | 3174 | 3189 | CAGACAAGATTCATGA | 81 | 297 |
| 1157461 | 3135 | 3150 | 3335 | 3350 | TACCCCAACTAAACAT | 82 | 298 |
| 1157495 | 3237 | 3252 | 3437 | 3452 | CCCCCCCGCCTCAGTT | 85 | 299 |
| 1157528 | 3339 | 3354 | 3539 | 3554 | ACACCTTGAGTCATTT | 50 | 300 |
| 1157562 | 3450 | 3465 | 3650 | 3665 | CCAATGGACATCTCTT | 60 | 301 |
| 1157594 | 3632 | 3647 | 3832 | 3847 | AATAGTACTATAGCAT | 85 | 302 |
| 1157627 | 3722 | 3737 | 3922 | 3937 | ATACTCTTCCAAGGAT | 65 | 303 |
| 1157661 | 3876 | 3891 | 4076 | 4091 | TTGCCCCTCCCCTTTA | 58 | 304 |
| 1157694 | 3946 | 3961 | 4146 | 4161 | CTAAACAATTACCTAA | 97 | 305 |
| 1157728 | 4053 | 4068 | 4253 | 4268 | AAACTAAATCATTGGG | 57 | 306 |
| 1157761 | 4191 | 4206 | 4391 | 4406 | CCCAAAAGCTCTATAC | 94 | 307 |
| 1157794 | 4284 | 4299 | 4484 | 4499 | ACTACCATATCCAAAC | 73 | 308 |
| 1157828 | 4448 | 4463 | 4648 | 4663 | TGCTTACACACAACTG | 65 | 309 |
| 1157861 | 4617 | 4632 | 4816 | 4831 | CACCCTCTAAGAGACA | 99 | 310 |
| 1157893 | 4753 | 4768 | 4952 | 4967 | CTTATCAATTCACCAA | 53 | 311 |
| 1157927 | 4819 | 4834 | 5018 | 5033 | AGTAAGAATCTCAGGG | 55 | 312 |
| 1157961 | 4921 | 4936 | 5120 | 5135 | TGACAAGCAATTAACT | 72 | 313 |
| 1157995 | 5053 | 5068 | 5252 | 5267 | TCCAGGATTAATGTAG | 52 | 314 |
| 1158061 | 5223 | 5238 | 5422 | 5437 | AACTTATCTGTTAACA | 70 | 315 |
| 1158094 | 5293 | 5308 | 5492 | 5507 | TATTTAAGAACTCCAC | 74 | 316 |
| 1158126 | 5391 | 5406 | 5590 | 5605 | ACAGGAACAAGTCCTA | 90 | 317 |
| 1158159 | 5492 | 5507 | 5691 | 5706 | TTAGTTGGCATCAAGG | 26 | 318 |
| 1158193 | 5615 | 5630 | 5814 | 5829 | TAATGGTTTTCTACAC | 60 | 319 |
| 1158226 | 5778 | 5793 | 5977 | 5992 | TAAAGAGTGTTCGCAG | 49 | 320 |
| 1158259 | 5902 | 5917 | 6101 | 6116 | TAGAGGGCCTCTATTG | 61 | 321 |

TABLE 34-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158292 | 5997 | 6012 | 6196 | 6211 | TTATAGACCCCTGACT | 90 | 322 |
| 1158326 | 6084 | 6099 | 6283 | 6298 | TTGCCTACCACTCTAA | 100 | 323 |
| 1158360 | 6209 | 6224 | 6408 | 6423 | CACTCATATGCAATTC | 63 | 324 |
| 1158392 | 6328 | 6343 | 6527 | 6542 | AACAAGTAAGCCCCAC | 89 | 325 |
| 1158426 | 6439 | 6454 | 6638 | 6653 | TAATAGCAGCGGGATC | 70 | 326 |
| 1158458 | 6540 | 6555 | 6739 | 6754 | AGCCTTTATCACTCAG | 65 | 327 |
| 1158491 | 6699 | 6714 | 6898 | 6913 | TGATTTTAAGGTTGCA | 30 | 328 |
| 1158522 | 6972 | 6987 | 7171 | 7186 | AAGAACTAGTGGTTCC | 70 | 329 |
| 1158555 | 7085 | 7100 | 7284 | 7299 | TGATCTGACTTTGTAT | 53 | 330 |
| 1158588 | 7162 | 7177 | 7361 | 7376 | CACGCCAACACAGTTT | 64 | 331 |
| 1158621 | 7309 | 7324 | 7508 | 7523 | CTTGACCTTAGGATAA | 56 | 332 |
| 1158655 | 7406 | 7421 | 7605 | 7620 | GGGTACTTCAAGCATT | 57 | 333 |
| 1158688 | 7525 | 7540 | 7724 | 7739 | GGGAAAAGTGGTTGCC | 91 | 334 |
| 1158722 | 7657 | 7672 | 7856 | 7871 | GGATCCAAGCTACTGG | 82 | 335 |
| 1158756 | 7711 | 7726 | 7910 | 7925 | CAAAGACCTCGACACC | 82 | 336 |
| 1158788 | 7784 | 7799 | 7983 | 7998 | CTGTGGTTTTAATACC | 49 | 337 |
| 1158822 | 7876 | 7891 | 8075 | 8090 | CCAGCATTACAGTTCT | 58 | 338 |
| 1158855 | 7987 | 8002 | 8186 | 8201 | GTTATGTTCACCTGAA | 39 | 339 |
| 1158888 | 8043 | 8058 | 8242 | 8257 | CCTACTGAAGAGCATT | 75 | 340 |
| 1158919 | 8217 | 8232 | 8416 | 8431 | GATTAGTAGTCAAAGC | 76 | 341 |
| 1158953 | 8331 | 8346 | 8530 | 8545 | CATCAAGGATGTATAT | 104 | 342 |
| 1158987 | 8448 | 8463 | 8647 | 8662 | CAGTAGGGCTTCTCAA | 90 | 343 |

TABLE 35

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 77 | 18 |
| 559497 | 3629 | 3644 | 3829 | 3844 | AGTACTATAGCATCTG | 102 | 32 |
| 559564 | 2839 | 2854 | 3039 | 3054 | CCATAAGTAAGTTCCA | 45 | 36 |
| 1156453 | 16 | 31 | N/A | N/A | AGTCTCGGGCTGCAGG | 97 | 344 |
| 1156486 | 168 | 183 | 134 | 149 | GACTCTGGGAAACCTG | 99 | 345 |
| 1156519 | 264 | 279 | 230 | 245 | CAGAGTTTGAGTGGTT | 84 | 346 |
| 1156553 | 357 | 372 | 323 | 338 | TGTGTTATGCCTGGTT | 99 | 347 |

TABLE 35-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1156587 | 487 | 502 | 453 | 468 | AGTAGACCAACTAAGC | 75 | 348 |
| 1156621 | 533 | 548 | 499 | 514 | TCACAAGGCAAATCGC | 93 | 349 |
| 1156655 | 613 | 628 | 579 | 594 | CCCCAGTTGCCGCCAG | 118 | 350 |
| 1156689 | 740 | 755 | 706 | 721 | TGCTTGGGAAATCTTA | 77 | 351 |
| 1156722 | 838 | 853 | 804 | 819 | GACTTTCTCCCCCAAC | 94 | 352 |
| 1156756 | 896 | 911 | 862 | 877 | TCCATTACGCAACTGA | 91 | 353 |
| 1156790 | 961 | 976 | 927 | 942 | GACAGTAGGTATAGTT | 113 | 354 |
| 1156824 | N/A | N/A | 1010 | 1025 | TTTTAAACGGGTCATC | 83 | 355 |
| 1156858 | N/A | N/A | 1152 | 1167 | AGGTTCTAGTTTTACT | 84 | 356 |
| 1156892 | 1019 | 1034 | 1219 | 1234 | CACCGGAATTCGATCA | 80 | 357 |
| 1156926 | 1073 | 1088 | 1273 | 1288 | TGCCTACCGCACAGCT | 81 | 358 |
| 1156960 | 1178 | 1193 | 1378 | 1393 | AGTAGTTGTATTAATC | 36 | 359 |
| 1156994 | 1336 | 1351 | 1536 | 1551 | TCTCAACCTCCGTCAT | 73 | 360 |
| 1157027 | 1517 | 1532 | 1717 | 1732 | TAAAAGATCGCCTTCA | 59 | 361 |
| 1157060 | 1592 | 1607 | 1792 | 1807 | AGGCTTTAAATGACGC | 111 | 362 |
| 1157094 | 1865 | 1880 | 2065 | 2080 | CTTCTAAGTTTGTACA | 53 | 363 |
| 1157128 | 2134 | 2149 | 2334 | 2349 | AAATTGGTTCTGGTCT | 52 | 364 |
| 1157162 | 2286 | 2301 | 2486 | 2501 | CAAACTAAGCTACTAT | 85 | 365 |
| 1157194 | 2346 | 2361 | 2546 | 2561 | TAAGTTGGTAATTACT | 83 | 366 |
| 1157228 | 2452 | 2467 | 2652 | 2667 | AGATTCACTGAATCCA | 94 | 367 |
| 1157262 | 2558 | 2573 | 2758 | 2773 | GGACTCTTTTCCTATC | 104 | 368 |
| 1157296 | 2682 | 2697 | 2882 | 2897 | CCTGCTACCTTCATCA | 78 | 369 |
| 1157329 | 2759 | 2774 | 2959 | 2974 | CACACTGGCATGCTGG | 91 | 370 |
| 1157363 | 2818 | 2833 | 3018 | 3033 | ACAACATATTGCCGAC | 90 | 371 |
| 1157397 | 2897 | 2912 | 3097 | 3112 | TCCCTTTACACCTCAG | 75 | 372 |
| 1157430 | 2975 | 2990 | 3175 | 3190 | TCAGACAAGATTCATG | 69 | 373 |
| 1157462 | 3136 | 3151 | 3336 | 3351 | TTACCCCAACTAAACA | 104 | 374 |
| 1157496 | 3238 | 3253 | 3438 | 3453 | TCCCCCCCGCCTCAGT | 84 | 375 |
| 1157529 | 3340 | 3355 | 3540 | 3555 | TACACCTTGAGTCATT | 62 | 376 |
| 1157563 | 3451 | 3466 | 3651 | 3666 | TCCAATGGACATCTCT | 75 | 377 |
| 1157595 | 3633 | 3648 | 3833 | 3848 | CAATAGTACTATAGCA | 93 | 378 |
| 1157628 | 3723 | 3738 | 3923 | 3938 | AATACTCTTCCAAGGA | 85 | 379 |
| 1157662 | 3880 | 3895 | 4080 | 4095 | ATATTTGCCCCTCCCC | 73 | 380 |
| 1157695 | 3947 | 3962 | 4147 | 4162 | ACTAAACAATTACCTA | 91 | 381 |
| 1157729 | 4092 | 4107 | 4292 | 4307 | TAACTTCCCCCAGCTT | 80 | 382 |
| 1157762 | 4192 | 4207 | 4392 | 4407 | CCCCAAAAGCTCTATA | 92 | 383 |

TABLE 35-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157795 | 4285 | 4300 | 4485 | 4500 | CACTACCATATCCAAA | 77 | 384 |
| 1157829 | 4449 | 4464 | 4649 | 4664 | TTGCTTACACACAACT | 82 | 385 |
| 1157862 | 4618 | 4633 | 4817 | 4832 | CCACCCTCTAAGAGAC | 117 | 386 |
| 1157894 | 4754 | 4769 | 4953 | 4968 | ACTTATCAATTCACCA | 72 | 387 |
| 1157928 | 4820 | 4835 | 5019 | 5034 | TAGTAAGAATCTCAGG | 40 | 388 |
| 1157962 | 4922 | 4937 | 5121 | 5136 | TTGACAAGCAATTAAC | 93 | 389 |
| 1157996 | 5054 | 5069 | 5253 | 5268 | TTCCAGGATTAATGTA | 63 | 390 |
| 1158028 | 5141 | 5156 | 5340 | 5355 | CTGAGGCAAACGAAAC | 106 | 391 |
| 1158062 | 5227 | 5242 | 5426 | 5441 | GTTAAACTTATCTGTT | 59 | 392 |
| 1158095 | 5295 | 5310 | 5494 | 5509 | GATATTTAAGAACTCC | 62 | 393 |
| 1158127 | 5392 | 5407 | 5591 | 5606 | CACAGGAACAAGTCCT | 84 | 394 |
| 1158160 | 5493 | 5508 | 5692 | 5707 | CTTAGTTGGCATCAAG | 69 | 395 |
| 1158194 | 5679 | 5694 | 5878 | 5893 | TAAGGAGACAGCTTTC | 84 | 396 |
| 1158227 | 5779 | 5794 | 5978 | 5993 | TTAAAGAGTGTTCGCA | 41 | 397 |
| 1158260 | 5903 | 5918 | 6102 | 6117 | TTAGAGGGCCTCTATT | 97 | 398 |
| 1158293 | 5998 | 6013 | 6197 | 6212 | TTTATAGACCCCTGAC | 78 | 399 |
| 1158327 | 6087 | 6102 | 6286 | 6301 | ACATTGCCTACCACTC | 84 | 400 |
| 1158361 | 6210 | 6225 | 6409 | 6424 | GCACTCATATGCAATT | 94 | 401 |
| 1158393 | 6329 | 6344 | 6528 | 6543 | CAACAAGTAAGCCCCA | 100 | 402 |
| 1158427 | 6440 | 6455 | 6639 | 6654 | CTAATAGCAGCGGGAT | 78 | 403 |
| 1158459 | 6541 | 6556 | 6740 | 6755 | CAGCCTTTATCACTCA | 51 | 404 |
| 1158492 | 6700 | 6715 | 6899 | 6914 | CTGATTTAAGGTTGC | 20 | 405 |
| 1158523 | 6973 | 6988 | 7172 | 7187 | AAAGAACTAGTGGTTC | 104 | 406 |
| 1158556 | 7087 | 7102 | 7286 | 7301 | ACTGATCTGACTTTGT | 68 | 407 |
| 1158589 | 7163 | 7178 | 7362 | 7377 | CCACGCCAACACAGTT | 69 | 408 |
| 1158622 | 7314 | 7329 | 7513 | 7528 | CTTCTCTTGACCTTAG | 39 | 409 |
| 1158656 | 7421 | 7436 | 7620 | 7635 | TTAAGAGAAGCCCAGG | 76 | 410 |
| 1158689 | 7527 | 7542 | 7726 | 7741 | TAGGGAAAAGTGGTTG | 113 | 411 |
| 1158723 | 7658 | 7673 | 7857 | 7872 | AGGATCCAAGCTACTG | 113 | 412 |
| 1158757 | 7712 | 7727 | 7911 | 7926 | CCAAAGACCTCGACAC | 87 | 413 |
| 1158789 | 7785 | 7800 | 7984 | 7999 | GCTGTGGTTTTAATAC | 51 | 414 |
| 1158823 | 7877 | 7892 | 8076 | 8091 | CCCAGCATTACAGTTC | 90 | 415 |
| 1158856 | 7988 | 8003 | 8187 | 8202 | TGTTATGTTCACCTGA | 65 | 416 |
| 1158889 | 8044 | 8059 | 8243 | 8258 | CCCTACTGAAGAGCAT | 87 | 417 |
| 1158920 | 8218 | 8233 | 8417 | 8432 | AGATTAGTAGTCAAAG | 112 | 418 |

TABLE 35-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158954 | 8332 | 8347 | 8531 | 8546 | ACATCAAGGATGTATA | 106 | 419 |
| 1158988 | 8449 | 8464 | 8648 | 8663 | GCAGTAGGGCTTCTCA | 108 | 420 |

TABLE 36

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 78 | 18 |
| 559497 | 3629 | 3644 | 3829 | 3844 | AGTACTATAGCATCTG | 98 | 32 |
| 559564 | 2839 | 2854 | 3039 | 3054 | CCATAAGTAAGTTCCA | 39 | 36 |
| 946407 | 3452 | 3467 | 3652 | 3667 | CTCCAATGGACATCTC | 71 | 421 |
| 1156454 | 17 | 32 | N/A | N/A | AAGTCTCGGGCTGCAG | 96 | 422 |
| 1156487 | 201 | 216 | 167 | 182 | AGATAGCAGCACAACT | 105 | 423 |
| 1156520 | 265 | 280 | 231 | 246 | GCAGAGTTTGAGTGGT | 109 | 424 |
| 1156554 | 358 | 373 | 324 | 339 | CTGTGTTATGCCTGGT | 103 | 425 |
| 1156588 | 488 | 503 | 454 | 469 | AAGTAGACCAACTAAG | 122 | 426 |
| 1156622 | 534 | 549 | 500 | 515 | CTCACAAGGCAAATCG | 112 | 427 |
| 1156656 | 616 | 631 | 582 | 597 | GCCCCCCAGTTGCCGC | 135 | 428 |
| 1156690 | 751 | 766 | 717 | 732 | CACGGGCTGTCTGCTT | 82 | 429 |
| 1156723 | 839 | 854 | 805 | 820 | GGACTTTCTCCCCCAA | 105 | 430 |
| 1156757 | 897 | 912 | 863 | 878 | TTCCATTACGCAACTG | 121 | 431 |
| 1156791 | 962 | 977 | 928 | 943 | GGACAGTAGGTATAGT | 89 | 432 |
| 1156825 | N/A | N/A | 1011 | 1026 | ATTTTAAACGGGTCAT | 93 | 433 |
| 1156859 | N/A | N/A | 1163 | 1178 | CGGTTAAAAATAGGTT | 94 | 434 |
| 1156893 | 1020 | 1035 | 1220 | 1235 | TCACCGGAATTCGATC | 363 | 435 |
| 1156927 | 1074 | 1089 | 1274 | 1289 | ATGCCTACCGCACAGC | 108 | 436 |
| 1156961 | 1200 | 1215 | 1400 | 1415 | AACCTATTGACTATAT | 81 | 437 |
| 1156995 | 1337 | 1352 | 1537 | 1552 | ATCTCAACCTCCGTCA | 66 | 438 |
| 1157028 | 1518 | 1533 | 1718 | 1733 | TTAAAAGATCGCCTTC | 57 | 439 |
| 1157061 | 1593 | 1608 | 1793 | 1808 | TAGGCTTTAAATGACG | 74 | 440 |
| 1157095 | 1866 | 1881 | 2066 | 2081 | TCTTCTAAGTTTGTAC | 37 | 441 |
| 1157129 | 2135 | 2150 | 2335 | 2350 | TAAATTGGTTCTGGTC | 51 | 442 |
| 1157163 | 2287 | 2302 | 2487 | 2502 | TCAAACTAAGCTACTA | 101 | 443 |
| 1157195 | 2347 | 2362 | 2547 | 2562 | TTAAGTTGGTAATTAC | 106 | 444 |
| 1157229 | 2453 | 2468 | 2653 | 2668 | TAGATTCACTGAATCC | 104 | 445 |

TABLE 36-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157263 | 2571 | 2586 | 2771 | 2786 | CGCACTGGCTCCTGGA | 51 | 446 |
| 1157297 | 2683 | 2698 | 2883 | 2898 | GCCTGCTACCTTCATC | 64 | 447 |
| 1157330 | 2763 | 2778 | 2963 | 2978 | TTGGCACACTGGCATG | 76 | 448 |
| 1157364 | 2820 | 2835 | 3020 | 3035 | AAACAACATATTGCCG | 80 | 449 |
| 1157398 | 2898 | 2913 | 3098 | 3113 | ATCCCTTTACACCTCA | 64 | 450 |
| 1157431 | 2976 | 2991 | 3176 | 3191 | TTCAGACAAGATTCAT | 49 | 451 |
| 1157463 | 3137 | 3152 | 3337 | 3352 | ATTACCCCAACTAAAC | 91 | 452 |
| 1157497 | 3239 | 3254 | 3439 | 3454 | CTCCCCCCCGCCTCAG | 88 | 453 |
| 1157530 | 3341 | 3356 | 3541 | 3556 | TTACACCTTGAGTCAT | 79 | 454 |
| 1157596 | 3634 | 3649 | 3834 | 3849 | TCAATAGTACTATAGC | 75 | 455 |
| 1157629 | 3724 | 3739 | 3924 | 3939 | GAATACTCTTCCAAGG | 84 | 456 |
| 1157663 | 3881 | 3896 | 4081 | 4096 | AATATTTGCCCCTCCC | 85 | 457 |
| 1157696 | 3959 | 3974 | 4159 | 4174 | CTGCAATCATAAACTA | 90 | 458 |
| 1157730 | 4093 | 4108 | 4293 | 4308 | TTAACTTCCCCCAGCT | 100 | 459 |
| 1157763 | 4210 | 4225 | 4410 | 4425 | CAGTTCAATACTTTCC | 55 | 460 |
| 1157796 | 4288 | 4303 | 4488 | 4503 | ACACACTACCATATCC | 103 | 461 |
| 1157830 | 4453 | 4468 | 4653 | 4668 | AAACTTGCTTACACAC | 75 | 462 |
| 1157863 | 4619 | 4634 | 4818 | 4833 | CCCACCCTCTAAGAGA | 104 | 463 |
| 1157895 | 4755 | 4770 | 4954 | 4969 | TACTTATCAATTCACC | 46 | 464 |
| 1157929 ✤ | 4821 | 4836 | 5020 | 5035 | GTAGTAAGAATCTCAG | 20 | 5 |
| 1157963 | 4923 | 4938 | 5122 | 5137 | CTTGACAAGCAATTAA | 70 | 465 |
| 1157997 | 5056 | 5071 | 5255 | 5270 | TATTCCAGGATTAATG | 71 | 466 |
| 1158029 | 5143 | 5158 | 5342 | 5357 | GTCTGAGGCAAACGAA | 71 | 467 |
| 1158063 | 5230 | 5245 | 5429 | 5444 | CAAGTTAAACTTATCT | 84 | 468 |
| 1158096 | 5298 | 5313 | 5497 | 5512 | GTTGATATTTAAGAAC | 115 | 469 |
| 1158128 | 5393 | 5408 | 5592 | 5607 | CCACAGGAACAAGTCC | 105 | 470 |
| 1158161 ✤ | 5494 | 5509 | 5693 | 5708 | CCTTAGTTGGCATCAA | 18 | 6 |
| 1158195 | 5683 | 5698 | 5882 | 5897 | TAAATAAGGAGACAGC | 62 | 471 |
| 1158228 | 5780 | 5795 | 5979 | 5994 | ATTAAAGAGTGTTCGC | 31 | 472 |
| 1158261 | 5904 | 5919 | 6103 | 6118 | TTTAGAGGGCCTCTAT | 83 | 473 |
| 1158294 | 5999 | 6014 | 6198 | 6213 | ATTTATAGACCCCTGA | 108 | 474 |
| 1158328 | 6089 | 6104 | 6288 | 6303 | AAACATTGCCTACCAC | 109 | 475 |
| 1158362 | 6212 | 6227 | 6411 | 6426 | AAGCACTCATATGCAA | 102 | 476 |
| 1158394 | 6330 | 6345 | 6529 | 6544 | ACAACAAGTAAGCCCC | 107 | 477 |
| 1158428 | 6441 | 6456 | 6640 | 6655 | TCTAATAGCAGCGGGA | 84 | 478 |
| 1158460 | 6542 | 6557 | 6741 | 6756 | TCAGCCTTTATCACTC | 87 | 479 |

TABLE 36-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158493 | 6701 | 6716 | 6900 | 6915 | ACTGATTTTAAGGTTG | 74 | 480 |
| 1158524 | 6975 | 6990 | 7174 | 7189 | TGAAAGAACTAGTGGT | 77 | 481 |
| 1158557 | 7088 | 7103 | 7287 | 7302 | AACTGATCTGACTTTG | 66 | 482 |
| 1158590 | 7165 | 7180 | 7364 | 7379 | CCCCACGCCAACACAG | 90 | 483 |
| 1158623 | 7317 | 7332 | 7516 | 7531 | ACACTTCTCTTGACCT | 40 | 484 |
| 1158657 | 7422 | 7437 | 7621 | 7636 | GTTAAGAGAAGCCCAG | 80 | 485 |
| 1158690 | 7528 | 7543 | 7727 | 7742 | CTAGGGAAAAGTGGTT | 122 | 486 |
| 1158724 | 7659 | 7674 | 7858 | 7873 | AAGGATCCAAGCTACT | 92 | 487 |
| 1158758 | 7713 | 7728 | 7912 | 7927 | ACCAAAGACCTCGACA | 86 | 488 |
| 1158790 | 7791 | 7806 | 7990 | 8005 | TACTTAGCTGTGGTTT | 77 | 489 |
| 1158824 | 7878 | 7893 | 8077 | 8092 | ACCCAGCATTACAGTT | 92 | 490 |
| 1158857 | 7989 | 8004 | 8188 | 8203 | CTGTTATGTTCACCTG | 44 | 491 |
| 1158890 | 8046 | 8061 | 8245 | 8260 | GACCCTACTGAAGAGC | 68 | 492 |
| 1158921 | 8220 | 8235 | 8419 | 8434 | ACAGATTAGTAGTCAA | 91 | 493 |
| 1158955 | 8333 | 8348 | 8532 | 8547 | TACATCAAGGATGTAT | 98 | 494 |
| 1158989 | 8450 | 8465 | 8649 | 8664 | AGCAGTAGGGCTTCTC | 97 | 495 |

TABLE 37

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 93 | 18 |
| 559497 | 3629 | 3644 | 3829 | 3844 | AGTACTATAGCATCTG | 107 | 32 |
| 559564 | 2839 | 2854 | 3039 | 3054 | CCATAAGTAAGTTCCA | 34 | 36 |
| 946421 | 7423 | 7438 | 7622 | 7637 | TGTTAAGAGAAGCCCA | 98 | 496 |
| 946426 | 8451 | 8466 | 8650 | 8665 | CAGCAGTAGGGCTTCT | 101 | 497 |
| 1156455 | 18 | 33 | N/A | N/A | GAAGTCTCGGGCTGCA | 94 | 498 |
| 1156488 | 202 | 217 | 168 | 183 | AAGATAGCAGCACAAC | 88 | 499 |
| 1156521 | 267 | 282 | 233 | 248 | CTGCAGAGTTTGAGTG | 119 | 500 |
| 1156555 | 359 | 374 | 325 | 340 | TCTGTGTTATGCCTGG | 83 | 501 |
| 1156589 | 490 | 505 | 456 | 471 | TAAAGTAGACCAACTA | 86 | 502 |
| 1156623 | 535 | 550 | 501 | 516 | GCTCACAAGGCAAATC | 104 | 503 |
| 1156657 | 618 | 633 | 584 | 599 | CGGCCCCCAGTTGCC | 83 | 504 |
| 1156691 | 752 | 767 | 718 | 733 | GCACGGGCTGTCTGCT | 112 | 505 |

TABLE 37-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1156724 | 840 | 855 | 806 | 821 | CGGACTTTCTCCCCCA | 109 | 506 |
| 1156758 | 899 | 914 | 865 | 880 | CTTTCCATTACGCAAC | 100 | 507 |
| 1156792 | 964 | 979 | 930 | 945 | AGGGACAGTAGGTATA | 84 | 508 |
| 1156826 | N/A | N/A | 1012 | 1027 | TATTTTAAACGGGTCA | 97 | 509 |
| 1156860 | N/A | N/A | 1164 | 1179 | TCGGTTAAAAATAGGT | 84 | 510 |
| 1156894 | 1021 | 1036 | 1221 | 1236 | ATCACCGGAATTCGAT | 83 | 511 |
| 1156928 | 1076 | 1091 | 1276 | 1291 | CAATGCCTACCGCACA | 84 | 512 |
| 1156962 | 1201 | 1216 | 1401 | 1416 | TAACCTATTGACTATA | 78 | 513 |
| 1156996 | 1339 | 1354 | 1539 | 1554 | TCATCTCAACCTCCGT | 43 | 514 |
| 1157029 | 1519 | 1534 | 1719 | 1734 | TTTAAAAGATCGCCTT | 50 | 515 |
| 1157062 | 1597 | 1612 | 1797 | 1812 | TAACTAGGCTTTAAAT | 86 | 516 |
| 1157096 | 1923 | 1938 | 2123 | 2138 | CTATCTGAAACTCTTG | 43 | 517 |
| 1157130 | 2136 | 2151 | 2336 | 2351 | CTAAATTGGTTCTGGT | 34 | 518 |
| 1157164 | 2288 | 2303 | 2488 | 2503 | TTCAAACTAAGCTACT | 69 | 519 |
| 1157196 | 2349 | 2364 | 2549 | 2564 | CATTAAGTTGGTAATT | 88 | 520 |
| 1157230 | 2454 | 2469 | 2654 | 2669 | CTAGATTCACTGAATC | 93 | 521 |
| 1157264 | 2572 | 2587 | 2772 | 2787 | TCGCACTGGCTCCTGG | 58 | 522 |
| 1157298 | 2684 | 2699 | 2884 | 2899 | CGCCTGCTACCTTCAT | 70 | 523 |
| 1157331 | 2769 | 2784 | 2969 | 2984 | GTGGCCTTGGCACACT | 110 | 524 |
| 1157365 | 2838 | 2853 | 3038 | 3053 | CATAAGTAAGTTCCAG | 51 | 525 |
| 1157399 | 2899 | 2914 | 3099 | 3114 | AATCCCTTTACACCTC | 74 | 526 |
| 1157432 | 2977 | 2992 | 3177 | 3192 | CTTCAGACAAGATTCA | 76 | 527 |
| 1157464 | 3138 | 3153 | 3338 | 3353 | CATTACCCCAACTAAA | 85 | 528 |
| 1157498 | 3240 | 3255 | 3440 | 3455 | ACTCCCCCCCGCCTCA | 74 | 529 |
| 1157531 | 3342 | 3357 | 3542 | 3557 | GTTACACCTTGAGTCA | 47 | 530 |
| 1157564 | 3453 | 3468 | 3653 | 3668 | TCTCCAATGGACATCT | 92 | 531 |
| 1157597 | 3635 | 3650 | 3835 | 3850 | GTCAATAGTACTATAG | 42 | 532 |
| 1157630 | 3725 | 3740 | 3925 | 3940 | GGAATACTCTTCCAAG | 94 | 533 |
| 1157664 | 3882 | 3897 | 4082 | 4097 | CAATATTTGCCCCTCC | 70 | 534 |
| 1157697 | 3965 | 3980 | 4165 | 4180 | GTTTATCTGCAATCAT | 43 | 535 |
| 1157731 | 4094 | 4109 | 4294 | 4309 | TTTAACTTCCCCCAGC | 102 | 536 |
| 1157764 | 4211 | 4226 | 4411 | 4426 | CCAGTTCAATACTTTC | 87 | 537 |
| 1157797 | 4290 | 4305 | 4490 | 4505 | CCACACACTACCATAT | 83 | 538 |
| 1157831 | 4496 | 4511 | 4695 | 4710 | TGCAGTTAAACAATGG | 38 | 539 |
| 1157864 | 4620 | 4635 | 4819 | 4834 | GCCCACCCTCTAAGAG | 82 | 540 |
| 1157896 | 4761 | 4776 | 4960 | 4975 | TGCCTTTACTTATCAA | 74 | 541 |

TABLE 37-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157930 | 4823 | 4838 | 5022 | 5037 | CAGTAGTAAGAATCTC | 46 | 542 |
| 1157964 | 4924 | 4939 | 5123 | 5138 | GCTTGACAAGCAATTA | 65 | 543 |
| 1157998 | 5057 | 5072 | 5256 | 5271 | TTATTCCAGGATTAAT | 105 | 544 |
| 1158030 | 5145 | 5160 | 5344 | 5359 | CTGTCTGAGGCAAACG | 63 | 545 |
| 1158064 | 5231 | 5246 | 5430 | 5445 | GCAAGTTAAACTTATC | 58 | 546 |
| 1158097 | 5304 | 5319 | 5503 | 5518 | GCCATGGTTGATATTT | 91 | 547 |
| 1158129 | 5394 | 5409 | 5593 | 5608 | CCCACAGGAACAAGTC | 86 | 548 |
| 1158162 * | 5495 | 5510 | 5694 | 5709 | TCCTTAGTTGGCATCA | 24 | 7 |
| 1158196 | 5706 | 5721 | 5905 | 5920 | CTACAGACAAACACTA | 94 | 549 |
| 1158229 | 5781 | 5796 | 5980 | 5995 | CATTAAAGAGTGTTCG | 66 | 550 |
| 1158262 | 5906 | 5921 | 6105 | 6120 | TATTTAGAGGGCCTCT | 66 | 551 |
| 1158295 | 6000 | 6015 | 6199 | 6214 | AATTTATAGACCCCTG | 96 | 552 |
| 1158329 | 6092 | 6107 | 6291 | 6306 | GTAAAACATTGCCTAC | 76 | 553 |
| 1158363 | 6214 | 6229 | 6413 | 6428 | CCAAGCACTCATATGC | 88 | 554 |
| 1158395 | 6331 | 6346 | 6530 | 6545 | TACAACAAGTAAGCCC | 80 | 555 |
| 1158429 | 6442 | 6457 | 6641 | 6656 | TTCTAATAGCAGCGGG | 41 | 556 |
| 1158461 | 6544 | 6559 | 6743 | 6758 | ACTCAGCCTTTATCAC | 105 | 557 |
| 1158494 | 6715 | 6730 | 6914 | 6929 | GAATGTTTCTTGTCAC | 57 | 558 |
| 1158525 | 6976 | 6991 | 7175 | 7190 | CTGAAAGAACTAGTGG | 80 | 559 |
| 1158558 | 7089 | 7104 | 7288 | 7303 | TAACTGATCTGACTTT | 74 | 560 |
| 1158591 | 7167 | 7182 | 7366 | 7381 | ACCCCCACGCCAACAC | 77 | 561 |
| 1158624 | 7319 | 7334 | 7518 | 7533 | TGACACTTCTCTTGAC | 70 | 562 |
| 1158691 | 7529 | 7544 | 7728 | 7743 | GCTAGGGAAAAGTGGT | 95 | 563 |
| 1158725 | 7660 | 7675 | 7859 | 7874 | CAAGGATCCAAGCTAC | 81 | 564 |
| 1158759 | 7714 | 7729 | 7913 | 7928 | CACCAAAGACCTCGAC | 82 | 565 |
| 1158791 | 7792 | 7807 | 7991 | 8006 | CTACTTAGCTGTGGTT | 67 | 566 |
| 1158825 | 7881 | 7896 | 8080 | 8095 | CCCACCCAGCATTACA | 82 | 567 |
| 1158858 | 7990 | 8005 | 8189 | 8204 | TCTGTTATGTTCACCT | 48 | 568 |
| 1158891 | 8047 | 8062 | 8246 | 8261 | TGACCCTACTGAAGAG | 79 | 569 |
| 1158922 | 8221 | 8236 | 8420 | 8435 | GACAGATTAGTAGTCA | 112 | 570 |
| 1158956 | 8334 | 8349 | 8533 | 8548 | ATACATCAAGGATGTA | 81 | 571 |

TABLE 38

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 110 | 18 |
| 559497 | 3629 | 3644 | 3829 | 3844 | AGTACTATAGCATCTG | 115 | 32 |
| 559564 | 2839 | 2854 | 3039 | 3054 | CCATAAGTAAGTTCCA | 60 | 36 |
| 1156456 | 19 | 34 | N/A | N/A | AGAAGTCTCGGGCTGC | 92 | 572 |
| 1156489 | 203 | 218 | 169 | 184 | TAAGATAGCAGCACAA | 103 | 573 |
| 1156522 | 274 | 289 | 240 | 255 | GACCAAACTGCAGAGT | 97 | 574 |
| 1156556 | 365 | 380 | 331 | 346 | GCAGATTCTGTGTTAT | 102 | 575 |
| 1156590 | 491 | 506 | 457 | 472 | TTAAAGTAGACCAACT | 73 | 576 |
| 1156624 | 539 | 554 | 505 | 520 | AAGTGCTCACAAGGCA | 116 | 577 |
| 1156658 | 619 | 634 | 585 | 600 | GCGGCCCCCAGTTGC | 116 | 578 |
| 1156692 | 753 | 768 | 719 | 734 | AGCACGGGCTGTCTGC | 93 | 579 |
| 1156725 | 841 | 856 | 807 | 822 | GCGGACTTTCTCCCCC | 124 | 580 |
| 1156759 | 900 | 915 | 866 | 881 | ACTTTCCATTACGCAA | 91 | 581 |
| 1156793 | 965 | 980 | 931 | 946 | GAGGGACAGTAGGTAT | 81 | 582 |
| 1156827 | N/A | N/A | 1013 | 1028 | ATATTTTAAACGGGTC | 84 | 583 |
| 1156861 | N/A | N/A | 1165 | 1180 | TTCGGTTAAAAATAGG | 107 | 584 |
| 1156895 | 1022 | 1037 | 1222 | 1237 | CATCACCGGAATTCGA | 98 | 585 |
| 1156929 | 1077 | 1092 | 1277 | 1292 | TCAATGCCTACCGCAC | 97 | 586 |
| 1156963 | 1202 | 1217 | 1402 | 1417 | GTAACCTATTGACTAT | 67 | 587 |
| 1156997 | 1348 | 1363 | 1548 | 1563 | GAAGAAGCTTCATCTC | 85 | 588 |
| 1157030 | 1520 | 1535 | 1720 | 1735 | TTTTAAAAGATCGCCT | 67 | 589 |
| 1157063 | 1599 | 1614 | 1799 | 1814 | GTTAACTAGGCTTTAA | 77 | 590 |
| 1157097 | 1948 | 1963 | 2148 | 2163 | CTTGTCTTAGCTTGTT | 29 | 591 |
| 1157131 | 2137 | 2152 | 2337 | 2352 | TCTAAATTGGTTCTGG | 45 | 592 |
| 1157165 | 2305 | 2320 | 2505 | 2520 | GAAAGTCCTTCACATT | 78 | 593 |
| 1157197 | 2350 | 2365 | 2550 | 2565 | ACATTAAGTTGGTAAT | 96 | 594 |
| 1157231 | 2463 | 2478 | 2663 | 2678 | GCTGTCTTCCTAGATT | 64 | 595 |
| 1157265 | 2574 | 2589 | 2774 | 2789 | AATCGCACTGGCTCCT | 75 | 596 |
| 1157299 | 2686 | 2701 | 2886 | 2901 | GCCGCCTGCTACCTTC | 88 | 597 |
| 1157332 | 2778 | 2793 | 2978 | 2993 | GCTTTCCCTGTGGCCT | 90 | 598 |
| 1157366 | 2840 | 2855 | 3040 | 3055 | ACCATAAGTAAGTTCC | 42 | 599 |
| 1157400 | 2900 | 2915 | 3100 | 3115 | AAATCCCTTTACACCT | 77 | 600 |
| 1157433 | 3001 | 3016 | 3201 | 3216 | GACTTGGCAGTCTGCC | 90 | 601 |
| 1157465 | 3139 | 3154 | 3339 | 3354 | TCATTACCCCAACTAA | 83 | 602 |
| 1157499 | 3241 | 3256 | 3441 | 3456 | AACTCCCCCCGCCTC | 94 | 603 |
| 1157532 | 3343 | 3358 | 3543 | 3558 | TGTTACACCTTGAGTC | 63 | 604 |

TABLE 38-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157565 | 3457 | 3472 | 3657 | 3672 | CATTTCTCCAATGGAC | 88 | 605 |
| 1157598 | 3636 | 3651 | 3836 | 3851 | TGTCAATAGTACTATA | 82 | 606 |
| 1157631 | 3726 | 3741 | 3926 | 3941 | GGGAATACTCTTCCAA | 86 | 607 |
| 1157665 | 3883 | 3898 | 4083 | 4098 | CCAATATTTGCCCCTC | 60 | 608 |
| 1157698 | 3966 | 3981 | 4166 | 4181 | AGTTTATCTGCAATCA | 54 | 609 |
| 1157732 | 4095 | 4110 | 4295 | 4310 | ATTTAACTTCCCCCAG | 82 | 610 |
| 1157765 | 4212 | 4227 | 4412 | 4427 | CCCAGTTCAATACTTT | 75 | 611 |
| 1157798 | 4292 | 4307 | 4492 | 4507 | AACCACACACTACCAT | 107 | 612 |
| 1157832 | 4513 | 4528 | 4712 | 4727 | ACCTTAACATCTTGTT | 85 | 613 |
| 1157865 | 4622 | 4637 | 4821 | 4836 | AAGCCCACCCTCTAAG | 79 | 614 |
| 1157897 | 4762 | 4777 | 4961 | 4976 | CTGCCTTTACTTATCA | 56 | 615 |
| 1157931 | 4824 | 4839 | 5023 | 5038 | TCAGTAGTAAGAATCT | 44 | 616 |
| 1157965 | 4925 | 4940 | 5124 | 5139 | AGCTTGACAAGCAATT | 84 | 617 |
| 1157999 | 5068 | 5083 | 5267 | 5282 | TTCGGCTTCTTTTATT | 56 | 618 |
| 1158031 | 5150 | 5165 | 5349 | 5364 | GATACCTGTCTGAGGC | 67 | 619 |
| 1158065 | 5232 | 5247 | 5431 | 5446 | TGCAAGTTAAACTTAT | 75 | 620 |
| 1158098 | 5305 | 5320 | 5504 | 5519 | TGCCATGGTTGATATT | 63 | 621 |
| 1158130 | 5395 | 5410 | 5594 | 5609 | GCCCACAGGAACAAGT | 75 | 622 |
| 1158163 | 5496 | 5511 | 5695 | 5710 | TTCCTTAGTTGGCATC | 26 | 623 |
| 1158197 | 5718 | 5733 | 5917 | 5932 | CCCAACACTGAACTAC | 81 | 624 |
| 1158230 | 5782 | 5797 | 5981 | 5996 | CCATTAAAGAGTGTTC | 36 | 625 |
| 1158263 | 5907 | 5922 | 6106 | 6121 | TTATTTAGAGGGCCTC | 43 | 626 |
| 1158296 | 6001 | 6016 | 6200 | 6215 | CAATTTATAGACCCCT | 106 | 627 |
| 1158330 | 6093 | 6108 | 6292 | 6307 | TGTAAAACATTGCCTA | 107 | 628 |
| 1158364 | 6215 | 6230 | 6414 | 6429 | GCCAAGCACTCTATATG | 76 | 629 |
| 1158396 | 6332 | 6347 | 6531 | 6546 | CTACAACAAGTAAGCC | 93 | 630 |
| 1158430 | 6443 | 6458 | 6642 | 6657 | ATTCTAATAGCAGCGG | 68 | 631 |
| 1158462 | 6548 | 6563 | 6747 | 6762 | CAACACTCAGCCTTTA | 101 | 632 |
| 1158495 | 6730 | 6745 | 6929 | 6944 | ACTGTTGCTTGTTTGG | 47 | 633 |
| 1158526 | 6985 | 7000 | 7184 | 7199 | GAATACCATCTGAAAG | 84 | 634 |
| 1158559 | 7090 | 7105 | 7289 | 7304 | ATAACTGATCTGACTT | 105 | 635 |
| 1158592 | 7170 | 7185 | 7369 | 7384 | TCCACCCCCACGCCAA | 109 | 636 |
| 1158625 | 7321 | 7336 | 7520 | 7535 | GCTGACACTTCTCTTG | 52 | 637 |
| 1158658 | 7424 | 7439 | 7623 | 7638 | ATGTTAAGAGAAGCCC | 117 | 638 |
| 1158692 | 7530 | 7545 | 7729 | 7744 | AGCTAGGGAAAAGTGG | 110 | 639 |
| 1158726 | 7661 | 7676 | 7860 | 7875 | ACAAGGATCCAAGCTA | 107 | 640 |

TABLE 38-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158760 | 7715 | 7730 | 7914 | 7929 | CCACCAAAGACCTCGA | 73 | 641 |
| 1158792 | 7793 | 7808 | 7992 | 8007 | GCTACTTAGCTGTGGT | 72 | 642 |
| 1158826 | 7882 | 7897 | 8081 | 8096 | TCCCACCCAGCATTAC | 73 | 643 |
| 1158859 | 7992 | 8007 | 8191 | 8206 | AGTCTGTTATGTTCAC | 46 | 644 |
| 1158892 | 8048 | 8063 | 8247 | 8262 | ATGACCCTACTGAAGA | 85 | 645 |
| 1158923 | 8222 | 8237 | 8421 | 8436 | AGACAGATTAGTAGTC | 108 | 646 |
| 1158957 | 8336 | 8351 | 8535 | 8550 | TTATACATCAAGGATG | 96 | 647 |
| 1158990 | 8457 | 8472 | 8656 | 8671 | AGTTTTCAGCAGTAGG | 121 | 648 |

TABLE 39

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 82 | 18 |
| 556110 | 7198 | 7213 | 7397 | 7412 | AAAAAAGGCTTAGCGC | 100 | 649 |
| 559497 | 3629 | 3644 | 3829 | 3844 | AGTACTATAGCATCTG | 131 | 32 |
| 559564 | 2839 | 2854 | 3039 | 3054 | CCATAAGTAAGTTCCA | 39 | 36 |
| 1156457 | 20 | 35 | N/A | N/A | CAGAAGTCTCGGGCTG | 81 | 650 |
| 1156490 | 204 | 219 | 170 | 185 | CTAAGATAGCAGCACA | 89 | 651 |
| 1156523 | 277 | 292 | 243 | 258 | CAAGACCAAACTGCAG | 128 | 652 |
| 1156557 | 406 | 421 | 372 | 387 | TTACACTGCTCTGGGT | 98 | 653 |
| 1156591 | 492 | 507 | 458 | 473 | TTTAAAGTAGACCAAC | 149 | 654 |
| 1156625 | 541 | 556 | 507 | 522 | GAAAGTGCTCACAAGG | 94 | 655 |
| 1156659 | 620 | 635 | 586 | 601 | TGCGGCCCCCCAGTTG | 106 | 656 |
| 1156693 | 754 | 769 | 720 | 735 | CAGCACGGGCTGTCTG | 133 | 657 |
| 1156726 | 842 | 857 | 808 | 823 | GGCGGACTTTCTCCCC | 117 | 658 |
| 1156760 | 901 | 916 | 867 | 882 | TACTTTCCATTACGCA | 84 | 659 |
| 1156794 | 966 | 981 | 932 | 947 | TGAGGGACAGTAGGTA | 82 | 660 |
| 1156828 | N/A | N/A | 1014 | 1029 | CATATTTTAAACGGGT | 116 | 661 |
| 1156862 | N/A | N/A | 1166 | 1181 | CTTCGGTTAAAAATAG | 96 | 662 |
| 1156896 | 1025 | 1040 | 1225 | 1240 | TCGCATCACCGGAATT | 96 | 663 |
| 1156930 | 1079 | 1094 | 1279 | 1294 | CCTCAATGCCTACCGC | 83 | 664 |
| 1156964 | 1203 | 1218 | 1403 | 1418 | AGTAACCTATTGACTA | 116 | 665 |
| 1156998 | 1354 | 1369 | 1554 | 1569 | CTCCATGAAGAAGCTT | 51 | 666 |
| 1157031 | 1522 | 1537 | 1722 | 1737 | CTTTTTAAAAGATCGC | 69 | 667 |

TABLE 39-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157064 | 1600 | 1615 | 1800 | 1815 | CGTTAACTAGGCTTTA | 48 | 668 |
| 1157098 | 1950 | 1965 | 2150 | 2165 | TACTTGTCTTAGCTTG | 49 | 669 |
| 1157132 | 2140 | 2155 | 2340 | 2355 | TCTTCTAAATTGGTTC | 51 | 670 |
| 1157166 | 2307 | 2322 | 2507 | 2522 | ACGAAAGTCCTTCACA | 89 | 671 |
| 1157198 | 2363 | 2378 | 2563 | 2578 | GTCCAATGCAAAACA | 105 | 672 |
| 1157232 | 2477 | 2492 | 2677 | 2692 | GAATCCTGTCTGCTGC | 67 | 673 |
| 1157266 | 2575 | 2590 | 2775 | 2790 | AAATCGCACTGGCTCC | 94 | 674 |
| 1157300 | 2688 | 2703 | 2888 | 2903 | AAGCCGCCTGCTACCT | 116 | 675 |
| 1157333 | 2779 | 2794 | 2979 | 2994 | CGCTTTCCCTGTGGCC | 102 | 676 |
| 1157367 | 2841 | 2856 | 3041 | 3056 | TACCATAAGTAAGTTC | 96 | 677 |
| 1157401 | 2901 | 2916 | 3101 | 3116 | TAAATCCCTTTACACC | 88 | 678 |
| 1157434 | 3002 | 3017 | 3202 | 3217 | GGACTTGGCAGTCTGC | 73 | 679 |
| 1157466 | 3140 | 3155 | 3340 | 3355 | TTCATTACCCCAACTA | 58 | 680 |
| 1157500 | 3243 | 3258 | 3443 | 3458 | AAAACTCCCCCCCGCC | 104 | 681 |
| 1157533 | 3344 | 3359 | 3544 | 3559 | CTGTTACACCTTGAGT | 67 | 682 |
| 1157566 | 3466 | 3481 | 3666 | 3681 | ACTACCAGCCATTTCT | 51 | 683 |
| 1157599 | 3640 | 3655 | 3840 | 3855 | AGTTTGTCAATAGTAC | 58 | 684 |
| 1157632 | 3727 | 3742 | 3927 | 3942 | TGGGAATACTCTTCCA | 89 | 685 |
| 1157666 | 3885 | 3900 | 4085 | 4100 | TGCCAATATTTGCCCC | 80 | 686 |
| 1157699 | 3970 | 3985 | 4170 | 4185 | CATGAGTTTATCTGCA | 106 | 687 |
| 1157733 | 4097 | 4112 | 4297 | 4312 | ATATTTAACTTCCCCC | 70 | 688 |
| 1157766 | 4213 | 4228 | 4413 | 4428 | CCCCAGTTCAATACTT | 75 | 689 |
| 1157799 | 4294 | 4309 | 4494 | 4509 | AGAACCACACACTACC | 77 | 690 |
| 1157833 | 4514 | 4529 | 4713 | 4728 | TACCTTAACATCTTGT | 86 | 691 |
| 1157866 | 4623 | 4638 | 4822 | 4837 | AAAGCCCACCCTCTAA | 126 | 692 |
| 1157898 | 4781 | 4796 | 4980 | 4995 | GTATGACATATAATCT | 45 | 693 |
| 1157932 | 4825 | 4840 | 5024 | 5039 | ATCAGTAGTAAGAATC | 77 | 694 |
| 1157966 | 4926 | 4941 | 5125 | 5140 | TAGCTTGACAAGCAAT | 88 | 695 |
| 1158000 | 5070 | 5085 | 5269 | 5284 | ATTTCGGCTTCTTTTA | 43 | 696 |
| 1158032 | 5151 | 5166 | 5350 | 5365 | AGATACCTGTCTGAGG | 88 | 697 |
| 1158066 | 5236 | 5251 | 5435 | 5450 | CAGATGCAAGTTAAAC | 60 | 698 |
| 1158099 | 5310 | 5325 | 5509 | 5524 | GAAAGTCCATGGTTG | 59 | 699 |
| 1158131 | 5408 | 5423 | 5607 | 5622 | TCCCATCACTGAAGCC | 56 | 700 |
| 1158164 | 5498 | 5513 | 5697 | 5712 | ATTTCCTTAGTTGGCA | 28 | 701 |
| 1158198 | 5720 | 5735 | 5919 | 5934 | GCCCAACACTGAACT | 89 | 702 |
| 1158231 | 5783 | 5798 | 5982 | 5997 | TCCATTAAAGAGTGTT | 44 | 703 |

TABLE 39-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158264 | 5908 | 5923 | 6107 | 6122 | CTTATTTAGAGGGCCT | 64 | 704 |
| 1158297 | 6002 | 6017 | 6201 | 6216 | TCAATTTATAGACCCC | 53 | 705 |
| 1158331 | 6094 | 6109 | 6293 | 6308 | GTGTAAAACATTGCCT | 100 | 706 |
| 1158365 | 6216 | 6231 | 6415 | 6430 | AGCCAAGCACTCATAT | 83 | 707 |
| 1158397 | 6333 | 6348 | 6532 | 6547 | GCTACAACAAGTAAGC | 91 | 708 |
| 1158431 | 6444 | 6459 | 6643 | 6658 | CATTCTAATAGCAGCG | 49 | 709 |
| 1158463 | 6575 | 6590 | 6774 | 6789 | GACTGCTTAAAACTGC | 64 | 710 |
| 1158496 | 6732 | 6747 | 6931 | 6946 | AGACTGTTGCTTGTTT | 99 | 711 |
| 1158527 | 6988 | 7003 | 7187 | 7202 | GAAGAATACCATCTGA | 95 | 712 |
| 1158560 | 7091 | 7106 | 7290 | 7305 | CATAACTGATCTGACT | 105 | 713 |
| 1158626 | 7322 | 7337 | 7521 | 7536 | GGCTGACACTTCTCTT | 48 | 714 |
| 1158659 | 7455 | 7470 | 7654 | 7669 | TTAAGAGCTGCTATAA | 94 | 715 |
| 1158693 | 7537 | 7552 | 7736 | 7751 | CTGGAAAAGCTAGGGA | 113 | 716 |
| 1158727 | 7662 | 7677 | 7861 | 7876 | CACAAGGATCCAAGCT | 82 | 717 |
| 1158761 | 7716 | 7731 | 7915 | 7930 | CCCACCAAAGACCTCG | 69 | 718 |
| 1158793 | 7794 | 7809 | 7993 | 8008 | AGCTACTTAGCTGTGG | 66 | 719 |
| 1158827 | 7889 | 7904 | 8088 | 8103 | TACATGTTCCCACCCA | 61 | 720 |
| 1158860 | 7997 | 8012 | 8196 | 8211 | GGCCAAGTCTGTTATG | 101 | 721 |
| 1158893 | 8049 | 8064 | 8248 | 8263 | CATGACCCTACTGAAG | 98 | 722 |
| 1158924 | 8227 | 8242 | 8426 | 8441 | CCTGAAGACAGATTAG | 76 | 723 |
| 1158958 | 8337 | 8352 | 8536 | 8551 | ATTATACATCAAGGAT | 83 | 724 |
| 1158991 | 8458 | 8473 | 8657 | 8672 | AAGTTTTCAGCAGTAG | 92 | 725 |

TABLE 40

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 81 | 18 |
| 559497 | 3629 | 3644 | 3829 | 3844 | AGTACTATAGCATCTG | 132 | 32 |
| 559564 | 2839 | 2854 | 3039 | 3054 | CCATAAGTAAGTTCCA | 49 | 36 |
| 946416 | 5909 | 5924 | 6108 | 6123 | CCTTATTTAGAGGGCC | 67 | 726 |
| 1156458 | 21 | 36 | N/A | N/A | ACAGAAGTCTCGGGCT | 81 | 727 |
| 1156491 | 205 | 220 | 171 | 186 | GCTAAGATAGCAGCAC | 71 | 728 |
| 1156524 | 280 | 295 | 246 | 261 | CCCCAAGACCAAACTG | 109 | 729 |

TABLE 40-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1156558 | 410 | 425 | 376 | 391 | GTGTTTACACTGCTCT | 94 | 730 |
| 1156592 | 495 | 510 | 461 | 476 | CCTTTTAAAGTAGACC | 122 | 731 |
| 1156626 | 545 | 560 | 511 | 526 | TCCTGAAAGTGCTCAC | 107 | 732 |
| 1156660 | 621 | 636 | 587 | 602 | CTGCGGCCCCCAGTT | 75 | 733 |
| 1156694 | 756 | 771 | 722 | 737 | AGCAGCACGGGCTGTC | 90 | 734 |
| 1156727 | 843 | 858 | 809 | 824 | TGGCGGACTTTCTCCC | 91 | 735 |
| 1156761 | 902 | 917 | 868 | 883 | TTACTTTCCATTACGC | 84 | 736 |
| 1156795 | 967 | 982 | 933 | 948 | TTGAGGGACAGTAGGT | 79 | 737 |
| 1156829 | N/A | N/A | 1015 | 1030 | TCATATTTTAAACGGG | 77 | 738 |
| 1156863 | N/A | N/A | 1167 | 1182 | TCTTCGGTTAAAAATA | 81 | 739 |
| 1156897 | 1026 | 1041 | 1226 | 1241 | CTCGCATCACCGGAAT | 114 | 740 |
| 1156931 | 1080 | 1095 | 1280 | 1295 | GCCTCAATGCCTACCG | 111 | 741 |
| 1156965 | 1204 | 1219 | 1404 | 1419 | TAGTAACCTATTGACT | 136 | 742 |
| 1156999 | 1356 | 1371 | 1556 | 1571 | TACTCCATGAAGAAGC | 126 | 743 |
| 1157032 | 1533 | 1548 | 1733 | 1748 | CGGTTTAATCTCTTTT | 20 | 744 |
| 1157065 | 1640 | 1655 | 1840 | 1855 | CCCAATTAATCTTTCC | 53 | 745 |
| 1157099 | 1951 | 1966 | 2151 | 2166 | ATACTTGTCTTAGCTT | 40 | 746 |
| 1157133 | 2156 | 2171 | 2356 | 2371 | TTCTAGCTTCAAGTAT | 75 | 747 |
| 1157167 | 2308 | 2323 | 2508 | 2523 | TACGAAAGTCCTTCAC | 65 | 748 |
| 1157199 | 2364 | 2379 | 2564 | 2579 | AGTCCAATGCAAAAAC | 77 | 749 |
| 1157233 | 2479 | 2494 | 2679 | 2694 | TGGAATCCTGTCTGCT | 83 | 750 |
| 1157267 | 2577 | 2592 | 2777 | 2792 | CCAAATCGCACTGGCT | 84 | 751 |
| 1157301 | 2691 | 2706 | 2891 | 2906 | GCCAAGCCGCCTGCTA | 80 | 752 |
| 1157334 | 2781 | 2796 | 2981 | 2996 | CTCGCTTTCCCTGTGG | 83 | 753 |
| 1157368 | 2842 | 2857 | 3042 | 3057 | TTACCATAAGTAAGTT | 120 | 754 |
| 1157402 | 2908 | 2923 | 3108 | 3123 | CCCCATATAAATCCCT | 107 | 755 |
| 1157435 | 3003 | 3018 | 3203 | 3218 | AGGACTTGGCAGTCTG | 70 | 756 |
| 1157467 | 3141 | 3156 | 3341 | 3356 | CTTCATTACCCCAACT | 86 | 757 |
| 1157501 | 3244 | 3259 | 3444 | 3459 | GAAAACTCCCCCCCGC | 104 | 758 |
| 1157534 | 3345 | 3360 | 3545 | 3560 | TCTGTTACACCTTGAG | 52 | 759 |
| 1157567 | 3468 | 3483 | 3668 | 3683 | TAACTACCAGCCATTT | 76 | 760 |
| 1157600 | 3641 | 3656 | 3841 | 3856 | CAGTTTGTCAATAGTA | 48 | 761 |
| 1157633 | 3729 | 3744 | 3929 | 3944 | ACTGGGAATACTCTTC | 72 | 762 |
| 1157667 | 3894 | 3909 | 4094 | 4109 | CCAACTAATTGCCAAT | 60 | 763 |
| 1157700 | 3974 | 3989 | 4174 | 4189 | CTGGCATGAGTTTATC | 73 | 764 |
| 1157734 | 4098 | 4113 | 4298 | 4313 | CATATTTAACTTCCCC | 75 | 765 |

TABLE 40-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157767 | 4216 | 4231 | 4416 | 4431 | AACCCCCAGTTCAATA | 80 | 766 |
| 1157800 | 4296 | 4311 | 4496 | 4511 | AGAGAACCACACACTA | 72 | 767 |
| 1157834 | 4515 | 4530 | 4714 | 4729 | ATACCTTAACATCTTG | 57 | 768 |
| 1157867 | 4630 | 4645 | 4829 | 4844 | ATCAACAAAAGCCCAC | 112 | 769 |
| 1157899 | 4783 | 4798 | 4982 | 4997 | AGGTATGACATATAAT | 65 | 770 |
| 1157933 | 4826 | 4841 | 5025 | 5040 | CATCAGTAGTAAGAAT | 86 | 771 |
| 1157967 | 4928 | 4943 | 5127 | 5142 | TATAGCTTGACAAGCA | 81 | 772 |
| 1158001 | 5071 | 5086 | 5270 | 5285 | TATTTCGGCTTCTTTT | 53 | 773 |
| 1158033 | 5152 | 5167 | 5351 | 5366 | GAGATACCTGTCTGAG | 60 | 774 |
| 1158067 | 5238 | 5253 | 5437 | 5452 | TGCAGATGCAAGTTAA | 51 | 775 |
| 1158100 | 5312 | 5327 | 5511 | 5526 | GAGAAAGTGCCATGGT | 74 | 776 |
| 1158132 | 5409 | 5424 | 5608 | 5623 | ATCCCATCACTGAAGC | 64 | 777 |
| 1158165 | 5499 | 5514 | 5698 | 5713 | AATTTCCTTAGTTGGC | 32 | 778 |
| 1158199 | 5722 | 5737 | 5921 | 5936 | TTGCCCCAACACTGAA | 93 | 779 |
| 1158232 | 5784 | 5799 | 5983 | 5998 | GTCCATTAAAGAGTGT | 53 | 780 |
| 1158298 | 6003 | 6018 | 6202 | 6217 | GTCAATTTATAGACCC | 82 | 781 |
| 1158332 | 6095 | 6110 | 6294 | 6309 | AGTGTAAAACATTGCC | 93 | 782 |
| 1158366 | 6217 | 6232 | 6416 | 6431 | GAGCCAAGCACTCATA | 94 | 783 |
| 1158398 | 6334 | 6349 | 6533 | 6548 | AGCTACAACAAGTAAG | 88 | 784 |
| 1158432 | 6447 | 6462 | 6646 | 6661 | ATGCATTCTAATAGCA | 101 | 785 |
| 1158464 | 6578 | 6593 | 6777 | 6792 | TACGACTGCTTAAAAC | 95 | 786 |
| 1158497 | 6734 | 6749 | 6933 | 6948 | GAAGACTGTTGCTTGT | 48 | 787 |
| 1158528 | 6989 | 7004 | 7188 | 7203 | TGAAGAATACCATCTG | 70 | 788 |
| 1158561 | 7092 | 7107 | 7291 | 7306 | CCATAACTGATCTGAC | 87 | 789 |
| 1158593 | 7215 | 7230 | 7414 | 7429 | GTACCTGAAAAATCTT | 97 | 790 |
| 1158627 | 7324 | 7339 | 7523 | 7538 | GAGGCTGACACTTCTC | 110 | 791 |
| 1158660 | 7456 | 7471 | 7655 | 7670 | ATTAAGAGCTGCTATA | 104 | 792 |
| 1158694 | 7538 | 7553 | 7737 | 7752 | TCTGGAAAAGCTAGGG | 121 | 793 |
| 1158728 | 7663 | 7678 | 7862 | 7877 | CCACAAGGATCCAAGC | 120 | 794 |
| 1158762 | 7717 | 7732 | 7916 | 7931 | ACCCACCAAAGACCTC | 91 | 795 |
| 1158794 | 7796 | 7811 | 7995 | 8010 | AGAGCTACTTAGCTGT | 84 | 796 |
| 1158828 | 7890 | 7905 | 8089 | 8104 | TTACATGTTCCCACCC | 81 | 797 |
| 1158861 | 8002 | 8017 | 8201 | 8216 | AGCTTGGCCAAGTCTG | 72 | 798 |
| 1158894 | 8052 | 8067 | 8251 | 8266 | CTTCATGACCCTACTG | 64 | 799 |
| 1158925 | 8239 | 8254 | 8438 | 8453 | TACAGAAAGAGTCCTG | 83 | 800 |

TABLE 40-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158959 | 8346 | 8361 | 8545 | 8560 | TCCTGACAAATTATAC | 72 | 801 |
| 1158992 | 8459 | 8474 | 8658 | 8673 | TAAGTTTTCAGCAGTA | 114 | 802 |

TABLE 41

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 101 | 18 |
| 559497 | 3629 | 3644 | 3829 | 3844 | AGTACTATAGCATCTG | 121 | 32 |
| 559564 | 2839 | 2854 | 3039 | 3054 | CCATAAGTAAGTTCCA | 36 | 36 |
| 568504 | 7891 | 7906 | 8090 | 8105 | GTTACATGTTCCCACC | 63 | 803 |
| 946400 | 757 | 772 | 723 | 738 | GAGCAGCACGGGCTGT | 86 | 804 |
| 946405 | 2692 | 2707 | 2892 | 2907 | AGCCAAGCCGCCTGCT | 80 | 805 |
| 1156459 | 22 | 37 | N/A | N/A | TACAGAAGTCTCGGGC | 72 | 806 |
| 1156492 | 207 | 222 | 173 | 188 | CAGCTAAGATAGCAGC | 92 | 807 |
| 1156525 | 282 | 297 | 248 | 263 | AACCCCAAGACCAAAC | 89 | 808 |
| 1156559 | 411 | 426 | 377 | 392 | AGTGTTTACACTGCTC | 78 | 809 |
| 1156593 | 497 | 512 | 463 | 478 | GGCCTTTTAAAGTAGA | 72 | 810 |
| 1156627 | 566 | 581 | 532 | 547 | CGTTTTTCAGCTTCCA | 93 | 811 |
| 1156661 | 622 | 637 | 588 | 603 | TCTGCGGCCCCCCAGT | 75 | 812 |
| 1156728 | 844 | 859 | 810 | 825 | ATGGCGGACTTTCTCC | 71 | 813 |
| 1156762 | 903 | 918 | 869 | 884 | TTTACTTTCCATTACG | 84 | 814 |
| 1156796 | 969 | 984 | 935 | 950 | TCTTGAGGGACAGTAG | 107 | 815 |
| 1156830 | N/A | N/A | 1016 | 1031 | ATCATATTTTAAACGG | 68 | 816 |
| 1156864 | N/A | N/A | 1168 | 1183 | TTCTTCGGTTAAAAAT | 98 | 817 |
| 1156898 | 1027 | 1042 | 1227 | 1242 | ACTCGCATCACCGGAA | 85 | 818 |
| 1156932 | 1082 | 1097 | 1282 | 1297 | CTGCCTCAATGCCTAC | 56 | 819 |
| 1156966 | 1205 | 1220 | 1405 | 1420 | TTAGTAACCTATTGAC | 66 | 820 |
| 1157000 | 1399 | 1414 | 1599 | 1614 | GCTCTGTAGTCCTTTC | 58 | 821 |
| 1157033 | 1534 | 1549 | 1734 | 1749 | TCGGTTTAATCTCTTT | 37 | 822 |
| 1157066 | 1642 | 1657 | 1842 | 1857 | CTCCCAATTAATCTTT | 73 | 823 |
| 1157100 | 1952 | 1967 | 2152 | 2167 | AATACTTGTCTTAGCT | 59 | 824 |
| 1157134 | 2159 | 2174 | 2359 | 2374 | CCCTTCTAGCTTCAAG | 62 | 825 |
| 1157168 | 2309 | 2324 | 2509 | 2524 | TTACGAAAGTCCTTCA | 72 | 826 |
| 1157200 | 2369 | 2384 | 2569 | 2584 | CTCAAAGTCCAATGCA | 52 | 827 |

TABLE 41-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157234 | 2490 | 2505 | 2690 | 2705 | ACACTGGTTCCTGGAA | 52 | 828 |
| 1157268 | 2578 | 2593 | 2778 | 2793 | ACCAAATCGCACTGGC | 97 | 829 |
| 1157335 | 2782 | 2797 | 2982 | 2997 | ACTCGCTTTCCCTGTG | 65 | 830 |
| 1157369 | 2843 | 2858 | 3043 | 3058 | GTTACCATAAGTAAGT | 98 | 831 |
| 1157403 | 2911 | 2926 | 3111 | 3126 | CGTCCCCATATAAATC | 99 | 832 |
| 1157436 | 3004 | 3019 | 3204 | 3219 | CAGGACTTGGCAGTCT | 86 | 833 |
| 1157468 | 3143 | 3158 | 3343 | 3358 | TACTTCATTACCCCAA | 66 | 834 |
| 1157502 | 3245 | 3260 | 3445 | 3460 | TGAAAACTCCCCCCCG | 79 | 835 |
| 1157535 | 3346 | 3361 | 3546 | 3561 | TTCTGTTACACCTTGA | 41 | 836 |
| 1157568 | 3469 | 3484 | 3669 | 3684 | GTAACTACCAGCCATT | 55 | 837 |
| 1157601 | 3643 | 3658 | 3843 | 3858 | CCCAGTTTGTCAATAG | 61 | 838 |
| 1157634 | 3730 | 3745 | 3930 | 3945 | AACTGGGAATACTCTT | 78 | 839 |
| 1157668 | 3895 | 3910 | 4095 | 4110 | GCCAACTAATTGCCAA | 67 | 840 |
| 1157701 | 3985 | 4000 | 4185 | 4200 | CTTTAAGTTCTCTGGC | 36 | 841 |
| 1157735 | 4102 | 4117 | 4302 | 4317 | GGCTCATATTTAACTT | 80 | 842 |
| 1157768 | 4218 | 4233 | 4418 | 4433 | CCAACCCCAGTTCAA | 76 | 843 |
| 1157801 | 4302 | 4317 | 4502 | 4517 | TCCAAAAGAGAACCAC | 79 | 844 |
| 1157835 | 4516 | 4531 | 4715 | 4730 | CATACCTTAACATCTT | 68 | 845 |
| 1157868 | 4632 | 4647 | 4831 | 4846 | TCATCAACAAAGCCC | 108 | 846 |
| 1157900 | 4784 | 4799 | 4983 | 4998 | GAGGTATGACATATAA | 46 | 847 |
| 1157934 | 4829 | 4844 | 5028 | 5043 | TCTCATCAGTAGTAAG | 45 | 848 |
| 1157968 | 4929 | 4944 | 5128 | 5143 | TTATAGCTTGACAAGC | 63 | 849 |
| 1158002 | 5074 | 5089 | 5273 | 5288 | ATTTATTTCGGCTTCT | 29 | 850 |
| 1158034 | 5153 | 5168 | 5352 | 5367 | AGAGATACCTGTCTGA | 78 | 851 |
| 1158068 | 5239 | 5254 | 5438 | 5453 | CTGCAGATGCAAGTTA | 51 | 852 |
| 1158101 | 5318 | 5333 | 5517 | 5532 | GGTCAGGAGAAAGTGC | 82 | 853 |
| 1158133 | 5413 | 5428 | 5612 | 5627 | TACTATCCCATCACTG | 58 | 854 |
| 1158166 | 5500 | 5515 | 5699 | 5714 | AAATTCCTTAGTTGG | 46 | 855 |
| 1158200 | 5725 | 5740 | 5924 | 5939 | AGATTGCCCCAACACT | 62 | 856 |
| 1158233 | 5790 | 5805 | 5989 | 6004 | GATCTGGTCCATTAAA | 75 | 857 |
| 1158265 | 5910 | 5925 | 6109 | 6124 | TCCTTATTTAGAGGGC | 71 | 858 |
| 1158299 | 6004 | 6019 | 6203 | 6218 | TGTCAATTTATAGACC | 94 | 859 |
| 1158333 | 6096 | 6111 | 6295 | 6310 | TAGTGTAAAACATTGC | 65 | 860 |
| 1158367 | 6219 | 6234 | 6418 | 6433 | AAGAGCCAAGCACTCA | 88 | 861 |
| 1158399 | 6335 | 6350 | 6534 | 6549 | AAGCTACAACAAGTAA | 90 | 862 |
| 1158433 | 6448 | 6463 | 6647 | 6662 | AATGCATTCTAATAGC | 83 | 863 |

TABLE 41-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158465 | 6579 | 6594 | 6778 | 6793 | ATACGACTGCTTAAAA | 80 | 864 |
| 1158498 | 6737 | 6752 | 6936 | 6951 | CTTGAAGACTGTTGCT | 58 | 865 |
| 1158529 | 6991 | 7006 | 7190 | 7205 | TCTGAAGAATACCATC | 85 | 866 |
| 1158562 | 7093 | 7108 | 7292 | 7307 | CCCATAACTGATCTGA | 58 | 867 |
| 1158594 | 7234 | 7249 | 7433 | 7448 | TCGGTGCCTTTAGTGA | 71 | 868 |
| 1158628 | 7327 | 7342 | 7526 | 7541 | GGTGAGGCTGACACTT | 73 | 869 |
| 1158661 | 7457 | 7472 | 7656 | 7671 | TATTAAGAGCTGCTAT | 75 | 870 |
| 1158695 | 7540 | 7555 | 7739 | 7754 | CTTCTGGAAAAGCTAG | 92 | 871 |
| 1158729 | 7664 | 7679 | 7863 | 7878 | CCCACAAGGATCCAAG | 91 | 872 |
| 1158763 | 7719 | 7734 | 7918 | 7933 | CAACCCACCAAAGACC | 98 | 873 |
| 1158795 | 7797 | 7812 | 7996 | 8011 | TAGAGCTACTTAGCTG | 82 | 874 |
| 1158862 | 8003 | 8018 | 8202 | 8217 | TAGCTTGGCCAAGTCT | 81 | 875 |
| 1158895 | 8055 | 8070 | 8254 | 8269 | AACCTTCATGACCCTA | 80 | 876 |
| 1158926 | 8266 | 8281 | 8465 | 8480 | ACTAGCACCTGCAGAG | 77 | 877 |
| 1158960 | 8347 | 8362 | 8546 | 8561 | CTCCTGACAAATTATA | 83 | 878 |
| 1158993 | 8461 | 8476 | 8660 | 8675 | GTTAAGTTTTCAGCAG | 83 | 879 |

TABLE 42

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 103 | 18 |
| 559497 | 3629 | 3644 | 3829 | 3844 | AGTACTATAGCATCTG | 137 | 32 |
| 559564 | 2839 | 2854 | 3039 | 3054 | CCATAAGTAAGTTCCA | 53 | 36 |
| 568486 | 6220 | 6235 | 6419 | 6434 | GAAGAGCCAAGCACTC | 109 | 880 |
| 1156460 | 23 | 38 | N/A | N/A | TTACAGAAGTCTCGGG | 89 | 881 |
| 1156493 | 208 | 223 | 174 | 189 | ACAGCTAAGATAGCAG | 98 | 882 |
| 1156526 | 316 | 331 | 282 | 297 | CCGGAGCAGGAAGAAA | 77 | 883 |
| 1156560 | 413 | 428 | 379 | 394 | GAAGTGTTTACACTGC | 89 | 884 |
| 1156594 | 499 | 514 | 465 | 480 | GTGGCCTTTTAAAGTA | 85 | 885 |
| 1156628 | 567 | 582 | 533 | 548 | CCGTTTTTCAGCTTCC | 94 | 886 |
| 1156662 | 623 | 638 | 589 | 604 | ATCTGCGGCCCCCCAG | 108 | 887 |
| 1156695 | 762 | 777 | 728 | 743 | AATCGGAGCAGCACGG | 74 | 888 |
| 1156729 | 845 | 860 | 811 | 826 | AATGGCGGACTTTCTC | 100 | 889 |

TABLE 42-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1156763 | 907 | 922 | 873 | 888 | GGGCTTTACTTTCCAT | 84 | 890 |
| 1156797 | 970 | 985 | 936 | 951 | CTCTTGAGGGACAGTA | 96 | 891 |
| 1156831 | N/A | N/A | 1046 | 1061 | CTGCAAACTTTAGACA | 93 | 892 |
| 1156865 | N/A | N/A | 1171 | 1186 | TAGTTCTTCGGTTAAA | 94 | 893 |
| 1156899 | 1028 | 1043 | 1228 | 1243 | AACTCGCATCACCGGA | 79 | 894 |
| 1156933 | 1090 | 1105 | 1290 | 1305 | TGCGCTGGCTGCCTCA | 75 | 895 |
| 1156967 | 1206 | 1221 | 1406 | 1421 | CTTAGTAACCTATTGA | 66 | 896 |
| 1157001 | 1416 | 1431 | 1616 | 1631 | ATTGGTATTAATTCGG | 30 | 897 |
| 1157034 | 1535 | 1550 | 1735 | 1750 | TTCGGTTTAATCTCTT | 25 | 2 |
| 1157067 | 1644 | 1659 | 1844 | 1859 | CACTCCCAATTAATCT | 92 | 898 |
| 1157101 | 1954 | 1969 | 2154 | 2169 | CCAATACTTGTCTTAG | 36 | 899 |
| 1157135 | 2164 | 2179 | 2364 | 2379 | ACTTCCCCTTCTAGCT | 64 | 900 |
| 1157169 | 2310 | 2325 | 2510 | 2525 | GTTACGAAAGTCCTTC | 55 | 901 |
| 1157201 | 2370 | 2385 | 2570 | 2585 | ACTCAAAGTCCAATGC | 69 | 902 |
| 1157235 | 2495 | 2510 | 2695 | 2710 | ATCAAACACTGGTTCC | 52 | 903 |
| 1157269 | 2579 | 2594 | 2779 | 2794 | CACCAAATCGCACTGG | 107 | 904 |
| 1157302 | 2693 | 2708 | 2893 | 2908 | AAGCCAAGCCGCCTGC | 71 | 905 |
| 1157336 | 2784 | 2799 | 2984 | 2999 | CCACTCGCTTTCCCTG | 59 | 906 |
| 1157370 | 2844 | 2859 | 3044 | 3059 | GGTTACCATAAGTAAG | 63 | 907 |
| 1157404 | 2925 | 2940 | 3125 | 3140 | CGGAAATCGGCCTACG | 70 | 908 |
| 1157437 | 3006 | 3021 | 3206 | 3221 | TCCAGGACTTGGCAGT | 77 | 909 |
| 1157469 | 3144 | 3159 | 3344 | 3359 | ATACTTCATTACCCCA | 50 | 910 |
| 1157503 | 3246 | 3261 | 3446 | 3461 | CTGAAAACTCCCCCCC | 102 | 911 |
| 1157536 | 3371 | 3386 | 3571 | 3586 | TATCCTGATATTGGAT | 76 | 912 |
| 1157569 | 3470 | 3485 | 3670 | 3685 | AGTAACTACCAGCCAT | 55 | 913 |
| 1157602 | 3644 | 3659 | 3844 | 3859 | ACCCAGTTTGTCAATA | 90 | 914 |
| 1157635 | 3731 | 3746 | 3931 | 3946 | CAACTGGGAATACTCT | 80 | 915 |
| 1157669 | 3896 | 3911 | 4096 | 4111 | TGCCAACTAATTGCCA | 77 | 916 |
| 1157702 | 3991 | 4006 | 4191 | 4206 | CTAAGACTTTAAGTTC | 73 | 917 |
| 1157736 | 4109 | 4124 | 4309 | 4324 | ACCCAGTGGCTCATAT | 84 | 918 |
| 1157769 | 4219 | 4234 | 4419 | 4434 | ACCAACCCCAGTTCA | 72 | 919 |
| 1157802 | 4351 | 4366 | 4551 | 4566 | GCAGTTTCTATAGTAG | 55 | 920 |
| 1157836 | 4517 | 4532 | 4716 | 4731 | GCATACCTTAACATCT | 46 | 921 |
| 1157869 | 4688 | 4703 | 4887 | 4902 | ACTCAGAAGATGTTAT | 70 | 922 |
| 1157901 | 4785 | 4800 | 4984 | 4999 | GGAGGTATGACATATA | 32 | 923 |
| 1157935 | 4838 | 4853 | 5037 | 5052 | AGATAATGTTCTCATC | 89 | 924 |

TABLE 42-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157969 | 4930 | 4945 | 5129 | 5144 | GTTATAGCTTGACAAG | 43 | 925 |
| 1158003 | 5075 | 5090 | 5274 | 5289 | CATTTATTTCGGCTTC | 34 | 926 |
| 1158035 | 5154 | 5169 | 5353 | 5368 | AAGAGATACCTGTCTG | 78 | 927 |
| 1158069 | 5244 | 5259 | 5443 | 5458 | CAATACTGCAGATGCA | 48 | 928 |
| 1158102 | 5334 | 5349 | 5533 | 5548 | AATCCCCTAGGGAAGG | 95 | 929 |
| 1158134 | 5414 | 5429 | 5613 | 5628 | GTACTATCCCATCACT | 67 | 930 |
| 1158167 | 5517 | 5532 | 5716 | 5731 | GAGATTCAATGCTAAA | 42 | 931 |
| 1158201 | 5727 | 5742 | 5926 | 5941 | CAAGATTGCCCCAACA | 88 | 932 |
| 1158234 | 5793 | 5808 | 5992 | 6007 | CCTGATCTGGTCCATT | 56 | 933 |
| 1158266 | 5911 | 5926 | 6110 | 6125 | TTCCTTATTTAGAGGG | 86 | 934 |
| 1158300 | 6007 | 6022 | 6206 | 6221 | CACTGTCAATTTATAG | 81 | 935 |
| 1158334 | 6097 | 6112 | 6296 | 6311 | ATAGTGTAAAACATTG | 100 | 936 |
| 1158400 | 6378 | 6393 | 6577 | 6592 | GTCAAGACAACTGCAT | 97 | 937 |
| 1158434 | 6449 | 6464 | 6648 | 6663 | CAATGCATTCTAATAG | 82 | 938 |
| 1158466 | 6580 | 6595 | 6779 | 6794 | AATACGACTGCTTAAA | 70 | 939 |
| 1158499 | 6738 | 6753 | 6937 | 6952 | TCTTGAAGACTGTTGC | 56 | 940 |
| 1158530 | 6992 | 7007 | 7191 | 7206 | GTCTGAAGAATACCAT | 53 | 941 |
| 1158563 | 7094 | 7109 | 7293 | 7308 | TCCCATAACTGATCTG | 69 | 942 |
| 1158595 | 7236 | 7251 | 7435 | 7450 | CTTCGGTGCCTTTAGT | 77 | 943 |
| 1158629 | 7331 | 7346 | 7530 | 7545 | ATCAGGTGAGGCTGAC | 77 | 944 |
| 1158662 | 7458 | 7473 | 7657 | 7672 | TTATTAAGAGCTGCTA | 73 | 945 |
| 1158696‡ | 7548 | 7563 | 7747 | 7762 | TTAACAGGCTTCTGGA | 56 | 946 |
| 1158730 | 7665 | 7680 | 7864 | 7879 | GCCCACAAGGATCCAA | 85 | 947 |
| 1158764 | 7722 | 7737 | 7921 | 7936 | GTTCAACCCACCAAAG | 64 | 948 |
| 1158796 | 7798 | 7813 | 7997 | 8012 | ATAGAGCTACTTAGCT | 81 | 949 |
| 1158829 | 7892 | 7907 | 8091 | 8106 | AGTTACATGTTCCCAC | 67 | 950 |
| 1158863 | 8005 | 8020 | 8204 | 8219 | GCTAGCTTGGCCAAGT | 98 | 951 |
| 1158896 | 8080 | 8095 | 8279 | 8294 | CGTGTTGTTTTCTCAG | 77 | 952 |
| 1158927 | 8267 | 8282 | 8466 | 8481 | AACTAGCACCTGCAGA | 83 | 953 |
| 1158961 | 8348 | 8363 | 8547 | 8562 | GCTCCTGACAAATTAT | 83 | 954 |
| 1158994 | 8492 | 8507 | 8691 | 8706 | TAGAGCTTCTCCATTT | 115 | 955 |

TABLE 43

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 127 | 18 |
| 559497 | 3629 | 3644 | 3829 | 3844 | AGTACTATAGCATCTG | 141 | 32 |
| 559564 | 2839 | 2854 | 3039 | 3054 | CCATAAGTAAGTTCCA | 60 | 36 |
| 946424 | 8006 | 8021 | 8205 | 8220 | TGCTAGCTTGGCCAAG | 84 | 956 |
| 1156461 | 24 | 39 | N/A | N/A | TTTACAGAAGTCTCGG | 131 | 957 |
| 1156494 | 209 | 224 | 175 | 190 | GACAGCTAAGATAGCA | 88 | 958 |
| 1156527 | 317 | 332 | 283 | 298 | ACCGGAGCAGGAAGAA | 96 | 959 |
| 1156561 | 418 | 433 | 384 | 399 | ACCCAGAAGTGTTTAC | 84 | 960 |
| 1156595 | 503 | 518 | 469 | 484 | TCAAGTGGCCTTTTAA | 138 | 961 |
| 1156629 | 568 | 583 | 534 | 549 | ACCGTTTTTCAGCTTC | 130 | 962 |
| 1156663 | 625 | 640 | 591 | 606 | TGATCTGCGGCCCCCC | 150 | 963 |
| 1156696 | 763 | 778 | 729 | 744 | AAATCGGAGCAGCACG | 84 | 964 |
| 1156730 | 846 | 861 | 812 | 827 | AAATGGCGGACTTTCT | 83 | 965 |
| 1156764 | 908 | 923 | 874 | 889 | AGGGCTTTACTTTCCA | 105 | 966 |
| 1156798 | 971 | 986 | 937 | 952 | TCTCTTGAGGGACAGT | 107 | 967 |
| 1156832 | N/A | N/A | 1047 | 1062 | GCTGCAAACTTTAGAC | 109 | 968 |
| 1156866 | N/A | N/A | 1174 | 1189 | AAGTAGTTCTTCGGTT | 90 | 969 |
| 1156900 | 1029 | 1044 | 1229 | 1244 | CAACTCGCATCACCGG | 91 | 970 |
| 1156934 | 1091 | 1106 | 1291 | 1306 | CTGCGCTGGCTGCCTC | 70 | 971 |
| 1156968 | 1207 | 1222 | 1407 | 1422 | TCTTAGTAACCTATTG | 81 | 972 |
| 1157002 | 1417 | 1432 | 1617 | 1632 | TATTGGTATTAATTCG | 87 | 973 |
| 1157035 | 1536 | 1551 | 1736 | 1751 | CTTCGGTTTAATCTCT | 27 | 974 |
| 1157068 | 1647 | 1662 | 1847 | 1862 | TACCACTCCCAATTAA | 88 | 975 |
| 1157102 | 1955 | 1970 | 2155 | 2170 | TCCAATACTTGTCTTA | 32 | 976 |
| 1157136 | 2169 | 2184 | 2369 | 2384 | AACCAACTTCCCCTTC | 84 | 977 |
| 1157170 | 2311 | 2326 | 2511 | 2526 | CGTTACGAAAGTCCTT | 75 | 978 |
| 1157202 | 2375 | 2390 | 2575 | 2590 | TCTTAACTCAAAGTCC | 61 | 979 |
| 1157236 | 2496 | 2511 | 2696 | 2711 | CATCAAACACTGGTTC | 86 | 980 |
| 1157270 | 2580 | 2595 | 2780 | 2795 | TCACCAAATCGCACTG | 80 | 981 |
| 1157303 | 2695 | 2710 | 2895 | 2910 | CCAAGCCAAGCCGCCT | 95 | 982 |
| 1157337 | 2785 | 2800 | 2985 | 3000 | ACCACTCGCTTTCCCT | 65 | 983 |
| 1157371 | 2845 | 2860 | 3045 | 3060 | AGGTTACCATAAGTAA | 90 | 984 |
| 1157405 | 2926 | 2941 | 3126 | 3141 | CCGGAAATCGGCCTAC | 80 | 985 |
| 1157438 | 3014 | 3029 | 3214 | 3229 | ACTATTTCTCCAGGAC | 80 | 986 |
| 1157470 | 3145 | 3160 | 3345 | 3360 | AATACTTCATTACCCC | 55 | 987 |
| 1157504 | 3247 | 3262 | 3447 | 3462 | ACTGAAAACTCCCCCC | 103 | 988 |

TABLE 43-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157537 | 3372 | 3387 | 3572 | 3587 | TTATCCTGATATTGGA | 112 | 989 |
| 1157570 | 3471 | 3486 | 3671 | 3686 | GAGTAACTACCAGCCA | 63 | 990 |
| 1157603 | 3647 | 3662 | 3847 | 3862 | CTAACCCAGTTTGTCA | 65 | 991 |
| 1157636 | 3732 | 3747 | 3932 | 3947 | TCAACTGGGAATACTC | 83 | 992 |
| 1157670 | 3897 | 3912 | 4097 | 4112 | CTGCCAACTAATTGCC | 132 | 993 |
| 1157703 | 3996 | 4011 | 4196 | 4211 | CCATTCTAAGACTTTA | 51 | 994 |
| 1157737 | 4112 | 4127 | 4312 | 4327 | TACACCCAGTGGCTCA | 70 | 995 |
| 1157770 | 4220 | 4235 | 4420 | 4435 | GACCAACCCCAGTTC | 97 | 996 |
| 1157803 | 4352 | 4367 | 4552 | 4567 | TGCAGTTTCTATAGTA | 91 | 997 |
| 1157837 | 4518 | 4533 | 4717 | 4732 | AGCATACCTTAACATC | 81 | 998 |
| 1157870 | 4694 | 4709 | 4893 | 4908 | GTTATGACTCAGAAGA | 74 | 999 |
| 1157902 | 4786 | 4801 | 4985 | 5000 | TGGAGGTATGACATAT | 41 | 1000 |
| 1157936 | 4840 | 4855 | 5039 | 5054 | GCAGATAATGTTCTCA | 27 | 10 |
| 1157970 | 4931 | 4946 | 5130 | 5145 | GGTTATAGCTTGACAA | 22 | 9 |
| 1158004 | 5077 | 5092 | 5276 | 5291 | CTCATTTATTTCGGCT | 22 | 1001 |
| 1158036 | 5155 | 5170 | 5354 | 5369 | GAAGAGATACCTGTCT | 122 | 1002 |
| 1158070 | 5245 | 5260 | 5444 | 5459 | GCAATACTGCAGATGC | 119 | 1003 |
| 1158103 | 5335 | 5350 | 5534 | 5549 | AAATCCCCTAGGGAAG | 108 | 1004 |
| 1158135 | 5415 | 5430 | 5614 | 5629 | TGTACTATCCCATCAC | 49 | 1005 |
| 1158168 | 5525 | 5540 | 5724 | 5739 | AGCCTTCAGAGATTCA | 25 | 1006 |
| 1158202 | 5728 | 5743 | 5927 | 5942 | CCAAGATTGCCCCAAC | 86 | 1007 |
| 1158235 | 5794 | 5809 | 5993 | 6008 | TCCTGATCTGGTCCAT | 58 | 1008 |
| 1158267 | 5912 | 5927 | 6111 | 6126 | ATTCCTTATTTAGAGG | 111 | 1009 |
| 1158301 | 6012 | 6027 | 6211 | 6226 | CTAATCACTGTCAATT | 101 | 1010 |
| 1158335 | 6101 | 6116 | 6300 | 6315 | GTCAATAGTGTAAAAC | 67 | 1011 |
| 1158368 | 6240 | 6255 | 6439 | 6454 | TACACTCACTAGAACA | 97 | 1012 |
| 1158401 | 6382 | 6397 | 6581 | 6596 | TGAAGTCAAGACAACT | 99 | 1013 |
| 1158435 | 6456 | 6471 | 6655 | 6670 | CGTTTCACAATGCATT | 53 | 1014 |
| 1158467 | 6581 | 6596 | 6780 | 6795 | AAATACGACTGCTTAA | 78 | 1015 |
| 1158500 | 6755 | 6770 | 6954 | 6969 | CACTTGCCAGTTTAAT | 71 | 1016 |
| 1158531 | 6994 | 7009 | 7193 | 7208 | TAGTCTGAAGAATACC | 77 | 1017 |
| 1158564 | 7095 | 7110 | 7294 | 7309 | GTCCCATAACTGATCT | 65 | 1018 |
| 1158596 | 7237 | 7252 | 7436 | 7451 | CCTTCGGTGCCTTTAG | 88 | 1019 |
| 1158630 | 7332 | 7347 | 7531 | 7546 | AATCAGGTGAGGCTGA | 126 | 1020 |
| 1158663 | 7460 | 7475 | 7659 | 7674 | TATTATTAAGAGCTGC | 106 | 1021 |
| 1158697‡ | 7552 | 7567 | 7751 | 7766 | GCTTTTAACAGGCTTC | 67 | 1022 |

TABLE 43-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158731 | 7667 | 7682 | 7866 | 7881 | ATGCCCACAAGGATCC | 67 | 1023 |
| 1158765 | 7724 | 7739 | 7923 | 7938 | TAGTTCAACCCACCAA | 114 | 1024 |
| 1158797 | 7800 | 7815 | 7999 | 8014 | TAATAGAGCTACTTAG | 116 | 1025 |
| 1158830 | 7893 | 7908 | 8092 | 8107 | AAGTTACATGTTCCCA | 61 | 1026 |
| 1158897 | 8094 | 8109 | 8293 | 8308 | CTGAGAAAACAATACG | 92 | 1027 |
| 1158928 | 8268 | 8283 | 8467 | 8482 | GAACTAGCACCTGCAG | 96 | 1028 |
| 1158962 | 8349 | 8364 | 8548 | 8563 | AGCTCCTGACAAATTA | 85 | 1029 |
| 1158995 | 8496 | 8511 | N/A | N/A | AATTTAGAGCTTCTCC | 79 | 1030 |

TABLE 44

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 101 | 18 |
| 559497 | 3629 | 3644 | 3829 | 3844 | AGTACTATAGCATCTG | 135 | 32 |
| 559564 | 2839 | 2854 | 3039 | 3054 | CCATAAGTAAGTTCCA | 55 | 36 |
| 946404 | 2312 | 2327 | 2512 | 2527 | CCGTTACGAAAGTCCT | 33 | 1031 |
| 946410 | 4113 | 4128 | 4313 | 4328 | GTACACCCAGTGGCTC | 94 | 1032 |
| 1156462 | 25 | 40 | N/A | N/A | CTTTACAGAAGTCTCG | 78 | 1033 |
| 1156495 | 210 | 225 | 176 | 191 | GGACAGCTAAGATAGC | 78 | 1034 |
| 1156528 | 318 | 333 | 284 | 299 | AACCGGAGCAGGAAGA | 116 | 1035 |
| 1156562 | 419 | 434 | 385 | 400 | CACCCAGAAGTGTTTA | 104 | 1036 |
| 1156596 | 505 | 520 | 471 | 486 | GTTCAAGTGGCCTTTT | 78 | 1037 |
| 1156630 | 569 | 584 | 535 | 550 | TACCGTTTTTCAGCTT | 131 | 1038 |
| 1156664 | 627 | 642 | 593 | 608 | TCTGATCTGCGGCCCC | 118 | 1039 |
| 1156697 | 764 | 779 | 730 | 745 | GAAATCGGAGCAGCAC | 99 | 1040 |
| 1156731 | 847 | 862 | 813 | 828 | AAAATGGCGGACTTTC | 70 | 1041 |
| 1156765 | 909 | 924 | 875 | 890 | CAGGGCTTTACTTTCC | 98 | 1042 |
| 1156799 | 978 | 993 | 944 | 959 | CTTGTGTTCTCTTGAG | 87 | 1043 |
| 1156833 | N/A | N/A | 1048 | 1063 | AGCTGCAAACTTTAGA | 74 | 1044 |
| 1156867 | N/A | N/A | 1175 | 1190 | AAAGTAGTTCTTCGGT | 83 | 1045 |
| 1156901 | 1030 | 1045 | 1230 | 1245 | ACAACTCGCATCACCG | 312 | 1046 |
| 1156935 | 1095 | 1110 | 1295 | 1310 | GCCCCTGCGCTGGCTG | 88 | 1047 |
| 1156969 | 1208 | 1223 | 1408 | 1423 | ATCTTAGTAACCTATT | 83 | 1048 |
| 1157003 | 1418 | 1433 | 1618 | 1633 | CTATTGGTATTAATTC | 93 | 1049 |

TABLE 44-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157036 | 1537 | 1552 | 1737 | 1752 | CCTTCGGTTTAATCTC | 39 | 1050 |
| 1157069 | 1649 | 1664 | 1849 | 1864 | CCTACCACTCCCAATT | 79 | 1051 |
| 1157103 | 1956 | 1971 | 2156 | 2171 | CTCCAATACTTGTCTT | 46 | 1052 |
| 1157137 | 2170 | 2185 | 2370 | 2385 | TAACCAACTTCCCCTT | 84 | 1053 |
| 1157203 | 2376 | 2391 | 2576 | 2591 | ATCTTAACTCAAAGTC | 61 | 1054 |
| 1157237 | 2497 | 2512 | 2697 | 2712 | TCATCAAACACTGGTT | 64 | 1055 |
| 1157271 | 2581 | 2596 | 2781 | 2796 | TTCACCAAATCGCACT | 71 | 1056 |
| 1157304 | 2696 | 2711 | 2896 | 2911 | GCCAAGCCAAGCCGCC | 86 | 1057 |
| 1157338 | 2786 | 2801 | 2986 | 3001 | AACCACTCGCTTTCCC | 59 | 1058 |
| 1157372 | 2846 | 2861 | 3046 | 3061 | AAGGTTACCATAAGTA | 54 | 1059 |
| 1157406 | 2927 | 2942 | 3127 | 3142 | CCCGGAAATCGGCCTA | 100 | 1060 |
| 1157439 | 3016 | 3031 | 3216 | 3231 | CTACTATTTCTCCAGG | 59 | 1061 |
| 1157471 | 3146 | 3161 | 3346 | 3361 | AAATACTTCATTACCC | 76 | 1062 |
| 1157505 | 3248 | 3263 | 3448 | 3463 | TACTGAAAACTCCCCC | 78 | 1063 |
| 1157538 | 3373 | 3388 | 3573 | 3588 | ATTATCCTGATATTGG | 54 | 1064 |
| 1157571 | 3472 | 3487 | 3672 | 3687 | AGAGTAACTACCAGCC | 45 | 1065 |
| 1157604 | 3648 | 3663 | 3848 | 3863 | TCTAACCCAGTTTGTC | 69 | 1066 |
| 1157637 | 3733 | 3748 | 3933 | 3948 | TTCAACTGGGAATACT | 83 | 1067 |
| 1157671 | 3899 | 3914 | 4099 | 4114 | CACTGCCAACTAATTG | 61 | 1068 |
| 1157704 | 4025 | 4040 | 4225 | 4240 | ACTTGGAAGTTGATAT | 96 | 1069 |
| 1157771 | 4221 | 4236 | 4421 | 4436 | AGACCAACCCCCAGTT | 100 | 1070 |
| 1157804 | 4353 | 4368 | 4553 | 4568 | CTGCAGTTTCTATAGT | 78 | 1071 |
| 1157838 | 4520 | 4535 | 4719 | 4734 | GAAGCATACCTTAACA | 95 | 1072 |
| 1157871 | 4695 | 4710 | 4894 | 4909 | GGTTATGACTCAGAAG | 42 | 1073 |
| 1157903 | 4787 | 4802 | 4986 | 5001 | ATGGAGGTATGACATA | 80 | 1074 |
| 1157937 | 4846 | 4861 | 5045 | 5060 | GCATATGCAGATAATG | 64 | 1075 |
| 1157971 | 4932 | 4947 | 5131 | 5146 | TGGTTATAGCTTGACA | 18 | 1076 |
| 1158005 | 5078 | 5093 | 5277 | 5292 | TCTCATTTATTTCGGC | 21 | 1077 |
| 1158037 | 5156 | 5171 | 5355 | 5370 | CGAAGAGATACCTGTC | 77 | 1078 |
| 1158071 | 5246 | 5261 | 5445 | 5460 | TGCAATACTGCAGATG | 80 | 1079 |
| 1158104 | 5336 | 5351 | 5535 | 5550 | GAAATCCCTAGGGAA | 94 | 1080 |
| 1158136 | 5416 | 5431 | 5615 | 5630 | GTGTACTATCCCATCA | 52 | 1081 |
| 1158169 | 5534 | 5549 | 5733 | 5748 | CTTTCATAGAGCCTTC | 57 | 1082 |
| 1158203 | 5729 | 5744 | 5928 | 5943 | CCCAAGATTGCCCCAA | 107 | 1083 |
| 1158236 | 5796 | 5811 | 5995 | 6010 | AATCCTGATCTGGTCC | 54 | 1084 |
| 1158268 | 5929 | 5944 | 6128 | 6143 | TGTCTAAGAGGTTATT | 90 | 1085 |

TABLE 44-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158302 | 6013 | 6028 | 6212 | 6227 | TCTAATCACTGTCAAT | 68 | 1086 |
| 1158336 | 6102 | 6117 | 6301 | 6316 | GGTCAATAGTGTAAAA | 57 | 1087 |
| 1158369 | 6243 | 6258 | 6442 | 6457 | TCATACACTCACTAGA | 122 | 1088 |
| 1158402 | 6383 | 6398 | 6582 | 6597 | CTGAAGTCAAGACAAC | 117 | 1089 |
| 1158436 | 6470 | 6485 | 6669 | 6684 | AATCATACTCCAGTCG | 65 | 1090 |
| 1158468 | 6583 | 6598 | 6782 | 6797 | ACAAATACGACTGCTT | 84 | 1091 |
| 1158501 | 6756 | 6771 | 6955 | 6970 | CCACTTGCCAGTTTAA | 71 | 1092 |
| 1158532 | 6997 | 7012 | 7196 | 7211 | CTATAGTCTGAAGAAT | 78 | 1093 |
| 1158565 | 7100 | 7115 | 7299 | 7314 | CTATTGTCCCATAACT | 62 | 1094 |
| 1158597 | 7238 | 7253 | 7437 | 7452 | GCCTTCGGTGCCTTTA | 102 | 1095 |
| 1158631 | 7354 | 7369 | 7553 | 7568 | GCAAGTCCTCATTACT | 50 | 1096 |
| 1158664 | 7466 | 7481 | 7665 | 7680 | GGGCTTTATTATTAAG | 124 | 1097 |
| 1158698‡ | 7562 | 7577 | 7761 | 7776 | GGGAGACCTTGCTTTT | 79 | 1098 |
| 1158732 | 7674 | 7689 | 7873 | 7888 | ATGGATCATGCCCACA | 88 | 1099 |
| 1158766 | 7725 | 7740 | 7924 | 7939 | ATAGTTCAACCCACCA | 79 | 1100 |
| 1158798 | 7801 | 7816 | 8000 | 8015 | ATAATAGAGCTACTTA | 81 | 1101 |
| 1158831 | 7894 | 7909 | 8093 | 8108 | CAAGTTACATGTTCCC | 58 | 1102 |
| 1158864 | 8008 | 8023 | 8207 | 8222 | GATGCTAGCTTGGCCA | 102 | 1103 |
| 1158898 | 8164 | 8179 | 8363 | 8378 | CAGGAGTGCCAACCAC | 102 | 1104 |
| 1158929 | 8269 | 8284 | 8468 | 8483 | AGAACTAGCACCTGCA | 85 | 1105 |
| 1158963 | 8353 | 8368 | 8552 | 8567 | GTCAAGCTCCTGACAA | 67 | 1106 |
| 1158996 | 8497 | 8512 | N/A | N/A | CAATTTAGAGCTTCTC | 112 | 1107 |

TABLE 45

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 106 | 18 |
| 556074 | 5797 | 5812 | 5996 | 6011 | AAATCCTGATCTGGTC | 73 | 1108 |
| 556090 | 6471 | 6486 | 6670 | 6685 | TAATCATACTCCAGTC | 103 | 1109 |
| 559497 | 3629 | 3644 | 3829 | 3844 | AGTACTATAGCATCTG | 128 | 32 |
| 559564 | 2839 | 2854 | 3039 | 3054 | CCATAAGTAAGTTCCA | 51 | 36 |
| 568476 | 5338 | 5353 | 5537 | 5552 | CTGAAATCCCTAGGG | 70 | 1110 |
| 1156463 | 28 | 43 | N/A | N/A | GTCCTTTACAGAAGTC | 65 | 1111 |

TABLE 45-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1156496 | 213 | 228 | 179 | 194 | TAAGGACAGCTAAGAT | 76 | 1112 |
| 1156529 | 319 | 334 | 285 | 300 | GAACCGGAGCAGGAAG | 72 | 1113 |
| 1156563 | 421 | 436 | 387 | 402 | CACACCCAGAAGTGTT | 87 | 1114 |
| 1156597 | 507 | 522 | 473 | 488 | GAGTTCAAGTGGCCTT | 83 | 1115 |
| 1156631 | 571 | 586 | 537 | 552 | TCTACCGTTTTTCAGC | 74 | 1116 |
| 1156665 | 628 | 643 | 594 | 609 | CTCTGATCTGCGGCCC | 106 | 1117 |
| 1156698 | 765 | 780 | 731 | 746 | AGAAATCGGAGCAGCA | 91 | 1118 |
| 1156732 | 848 | 863 | 814 | 829 | CAAAATGGCGGACTTT | 83 | 1119 |
| 1156766 | 916 | 931 | 882 | 897 | GATAGTTCAGGGCTTT | 90 | 1120 |
| 1156800 | 990 | 1005 | 956 | 971 | CTTAAAGCACTTCTTG | 134 | 1121 |
| 1156834 | N/A | N/A | 1054 | 1069 | GATTTGAGCTGCAAAC | 100 | 1122 |
| 1156868 | N/A | N/A | 1176 | 1191 | AAAAGTAGTTCTTCGG | 82 | 1123 |
| 1156902 | 1031 | 1046 | 1231 | 1246 | AACAACTCGCATCACC | 83 | 1124 |
| 1156936 | 1098 | 1113 | 1298 | 1313 | GAAGCCCTGCGCTGG | 77 | 1125 |
| 1156970 | 1209 | 1224 | 1409 | 1424 | TATCTTAGTAACCTAT | 79 | 1126 |
| 1157004 | 1421 | 1436 | 1621 | 1636 | CTTCTATTGGTATTAA | 82 | 1127 |
| 1157037 | 1539 | 1554 | 1739 | 1754 | CACCTTCGGTTTAATC | 80 | 1128 |
| 1157070 | 1650 | 1665 | 1850 | 1865 | TCCTACCACTCCCAAT | 70 | 1129 |
| 1157104 | 1962 | 1977 | 2162 | 2177 | ATACTTCTCCAATACT | 115 | 1130 |
| 1157138 | 2171 | 2186 | 2371 | 2386 | TTAACCAACTTCCCCT | 57 | 1131 |
| 1157171 | 2313 | 2328 | 2513 | 2528 | TCCGTTACGAAAGTCC | 36 | 1132 |
| 1157204 | 2401 | 2416 | 2601 | 2616 | GCTAGTCCTCAGGATT | 53 | 1133 |
| 1157238 | 2501 | 2516 | 2701 | 2716 | AGCTTCATCAAACACT | 97 | 1134 |
| 1157272 | 2582 | 2597 | 2782 | 2797 | CTTCACCAAATCGCAC | 113 | 1135 |
| 1157305 | 2697 | 2712 | 2897 | 2912 | TGCCAAGCCAAGCCGC | 87 | 1136 |
| 1157339 | 2788 | 2803 | 2988 | 3003 | CCAACCACTCGCTTTC | 74 | 1137 |
| 1157373 | 2847 | 2862 | 3047 | 3062 | AAAGGTTACCATAAGT | 95 | 1138 |
| 1157407 | 2928 | 2943 | 3128 | 3143 | ACCCGGAAATCGGCCT | 106 | 1139 |
| 1157440 | 3021 | 3036 | 3221 | 3236 | GCCATCTACTATTTCT | 62 | 1140 |
| 1157472 | 3167 | 3182 | 3367 | 3382 | GGTCATCTATTCACAA | 71 | 1141 |
| 1157506 | 3249 | 3264 | 3449 | 3464 | ATACTGAAAACTCCCC | 86 | 1142 |
| 1157539 | 3374 | 3389 | 3574 | 3589 | GATTATCCTGATATTG | 96 | 1143 |
| 1157572 | 3473 | 3488 | 3673 | 3688 | AAGAGTAACTACCAGC | 94 | 1144 |
| 1157605 | 3649 | 3664 | 3849 | 3864 | CTCTAACCCAGTTTGT | 64 | 1145 |
| 1157638 | 3734 | 3749 | 3934 | 3949 | CTTCAACTGGGAATAC | 93 | 1146 |
| 1157672 | 3907 | 3922 | 4107 | 4122 | TAACAGGCCACTGCCA | 89 | 1147 |

TABLE 45-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157705 | 4026 | 4041 | 4226 | 4241 | AACTTGGAAGTTGATA | 81 | 1148 |
| 1157738 | 4115 | 4130 | 4315 | 4330 | TGGTACACCCAGTGGC | 83 | 1149 |
| 1157772 | 4222 | 4237 | 4422 | 4437 | CAGACCAACCCCCAGT | 107 | 1150 |
| 1157805 | 4355 | 4370 | 4555 | 4570 | CTCTGCAGTTTCTATA | 69 | 1151 |
| 1157839 | 4521 | 4536 | 4720 | 4735 | TGAAGCATACCTTAAC | 69 | 1152 |
| 1157872 | 4696 | 4711 | 4895 | 4910 | TGGTTATGACTCAGAA | 52 | 1153 |
| 1157904 | 4788 | 4803 | 4987 | 5002 | AATGGAGGTATGACAT | 95 | 1154 |
| 1157938 | 4848 | 4863 | 5047 | 5062 | TGGCATATGCAGATAA | 31 | 1155 |
| 1157972 | 4933 | 4948 | 5132 | 5147 | GTGGTTATAGCTTGAC | 21 | 1156 |
| 1158006 | 5079 | 5094 | 5278 | 5293 | CTCTCATTTATTTCGG | 41 | 1157 |
| 1158038 | 5157 | 5172 | 5356 | 5371 | ACGAAGAGATACCTGT | 82 | 1158 |
| 1158072 | 5247 | 5262 | 5446 | 5461 | ATGCAATACTGCAGAT | 99 | 1159 |
| 1158137 | 5417 | 5432 | 5616 | 5631 | AGTGTACTATCCCATC | 22 | 1160 |
| 1158170 | 5535 | 5550 | 5734 | 5749 | CCTTTCATAGAGCCTT | 31 | 1161 |
| 1158204 | 5731 | 5746 | 5930 | 5945 | CCCCCAAGATTGCCCC | 89 | 1162 |
| 1158269 | 5930 | 5945 | 6129 | 6144 | CTGTCTAAGAGGTTAT | 93 | 1163 |
| 1158303 | 6014 | 6029 | 6213 | 6228 | CTCTAATCACTGTCAA | 89 | 1164 |
| 1158337 | 6103 | 6118 | 6302 | 6317 | AGGTCAATAGTGTAAA | 43 | 1165 |
| 1158370 | 6244 | 6259 | 6443 | 6458 | CTCATACACTCACTAG | 100 | 1166 |
| 1158403 | 6384 | 6399 | 6583 | 6598 | CCTGAAGTCAAGACAA | 100 | 1167 |
| 1158469 | 6584 | 6599 | 6783 | 6798 | CACAAATACGACTGCT | 76 | 1168 |
| 1158502 | 6776 | 6791 | 6975 | 6990 | ACTGAACTGTTTAAAC | 94 | 1169 |
| 1158533 | 6998 | 7013 | 7197 | 7212 | TCTATAGTCTGAAGAA | 74 | 1170 |
| 1158566 | 7102 | 7117 | 7301 | 7316 | TACTATTGTCCCATAA | 78 | 1171 |
| 1158598 | 7239 | 7254 | 7438 | 7453 | AGCCTTCGGTGCCTTT | 95 | 1172 |
| 1158632 | 7356 | 7371 | 7555 | 7570 | AGGCAAGTCCTCATTA | 84 | 1173 |
| 1158665 | 7471 | 7486 | 7670 | 7685 | GATTTGGGCTTTATTA | 77 | 1174 |
| 1158699‡ | 7577 | 7592 | 7776 | 7791 | GAGAAGTTGCTTGTGG | 45 | 1175 |
| 1158733 | 7675 | 7690 | 7874 | 7889 | TATGGATCATGCCCAC | 73 | 1176 |
| 1158767 | 7726 | 7741 | 7925 | 7940 | CATAGTTCAACCCACC | 65 | 1177 |
| 1158799 | 7802 | 7817 | 8001 | 8016 | TATAATAGAGCTACTT | 85 | 1178 |
| 1158832 | 7895 | 7910 | 8094 | 8109 | ACAAGTTACATGTTCC | 79 | 1179 |
| 1158865 | 8010 | 8025 | 8209 | 8224 | AAGATGCTAGCTTGGC | 76 | 1180 |
| 1158899 | 8165 | 8180 | 8364 | 8379 | CCAGGAGTGCCAACCA | 95 | 1181 |
| 1158930 | 8270 | 8285 | 8469 | 8484 | AAGAACTAGCACCTGC | 87 | 1182 |

TABLE 45-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158964 | 8354 | 8369 | 8553 | 8568 | AGTCAAGCTCCTGACA | 87 | 1183 |
| 1158997 | 8500 | 8515 | N/A | N/A | CAACAATTTAGAGCTT | 88 | 1184 |

TABLE 46

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 104 | 18 |
| 559497 | 3629 | 3644 | 3829 | 3844 | AGTACTATAGCATCTG | 104 | 32 |
| 559564 | 2839 | 2854 | 3039 | 3054 | CCATAAGTAAGTTCCA | 60 | 36 |
| 567936 | 5248 | 5263 | 5447 | 5462 | CATGCAATACTGCAGA | 85 | 1185 |
| 946414 | 5339 | 5354 | 5538 | 5553 | CCTGAAATCCCCTAGG | 104 | 1186 |
| 1156464 | 30 | 45 | N/A | N/A | CAGTCCTTTACAGAAG | 88 | 1187 |
| 1156497 | 214 | 229 | 180 | 195 | ATAAGGACAGCTAAGA | 92 | 1188 |
| 1156530 | 320 | 335 | 286 | 301 | TGAACCGGAGCAGGAA | 95 | 1189 |
| 1156564 | 429 | 444 | 395 | 410 | GTCAGGGACACACCCA | 111 | 1190 |
| 1156598 | 508 | 523 | 474 | 489 | CGAGTTCAAGTGGCCT | 82 | 1191 |
| 1156632 | 572 | 587 | 538 | 553 | TTCTACCGTTTTTCAG | 90 | 1192 |
| 1156666 | 629 | 644 | 595 | 610 | ACTCTGATCTGCGGCC | 87 | 1193 |
| 1156699 | 766 | 781 | 732 | 747 | GAGAAATCGGAGCAGC | 85 | 1194 |
| 1156733 | 849 | 864 | 815 | 830 | GCAAAATGGCGGACTT | 104 | 1195 |
| 1156767 | 917 | 932 | 883 | 898 | TGATAGTTCAGGGCTT | 91 | 1196 |
| 1156801 | N/A | N/A | 960 | 975 | ACCTCTTAAAGCACTT | 82 | 1197 |
| 1156835 | N/A | N/A | 1055 | 1070 | AGATTTGAGCTGCAAA | 89 | 1198 |
| 1156869 | N/A | N/A | 1177 | 1192 | AAAAAGTAGTTCTTCG | 84 | 1199 |
| 1156903 | 1032 | 1047 | 1232 | 1247 | GAACAACTCGCATCAC | 85 | 1200 |
| 1156937 | 1100 | 1115 | 1300 | 1315 | CAGAAGCCCCTGCGCT | 97 | 1201 |
| 1156971 | 1210 | 1225 | 1410 | 1425 | ATATCTTAGTAACCTA | 85 | 1202 |
| 1157005 | 1422 | 1437 | 1622 | 1637 | CCTTCTATTGGTATTA | 72 | 1203 |
| 1157038 | 1540 | 1555 | 1740 | 1755 | TCACCTTCGGTTTAAT | 72 | 1204 |
| 1157071 | 1651 | 1666 | 1851 | 1866 | ATCCTACCACTCCCAA | 66 | 1205 |
| 1157105 | 1963 | 1978 | 2163 | 2178 | TATACTTCTCCAATAC | 82 | 1206 |
| 1157139 | 2181 | 2196 | 2381 | 2396 | GATGTGATTTTTAACC | 48 | 1207 |
| 1157172 | 2314 | 2329 | 2514 | 2529 | TTCCGTTACGAAAGTC | 67 | 1208 |
| 1157205 | 2402 | 2417 | 2602 | 2617 | TGCTAGTCCTCAGGAT | 81 | 1209 |

TABLE 46-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157239 | 2504 | 2519 | 2704 | 2719 | CCTAGCTTCATCAAAC | 102 | 1210 |
| 1157273 | 2584 | 2599 | 2784 | 2799 | TCCTTCACCAAATCGC | 64 | 1211 |
| 1157306 | 2704 | 2719 | 2904 | 2919 | GTGTGGTTGCCAAGCC | 57 | 1212 |
| 1157340 | 2790 | 2805 | 2990 | 3005 | TACCAACCACTCGCTT | 99 | 1213 |
| 1157374 | 2870 | 2885 | 3070 | 3085 | CCCATTATATTAGAAA | 90 | 1214 |
| 1157408 | 2929 | 2944 | 3129 | 3144 | CACCCGGAAATCGGCC | 101 | 1215 |
| 1157441 | 3022 | 3037 | 3222 | 3237 | TGCCATCTACTATTTC | 81 | 1216 |
| 1157473 | 3168 | 3183 | 3368 | 3383 | AGGTCATCTATTCACA | 61 | 1217 |
| 1157507 | 3278 | 3293 | 3478 | 3493 | ATATTTTGCCCCCACC | 98 | 1218 |
| 1157540 | 3376 | 3391 | 3576 | 3591 | CTGATTATCCTGATAT | 67 | 1219 |
| 1157573 | 3474 | 3489 | 3674 | 3689 | AAAGAGTAACTACCAG | 78 | 1220 |
| 1157606 | 3650 | 3665 | 3850 | 3865 | TCTCTAACCCAGTTTG | 84 | 1221 |
| 1157639 | 3736 | 3751 | 3936 | 3951 | AGCTTCAACTGGGAAT | 87 | 1222 |
| 1157673 | 3908 | 3923 | 4108 | 4123 | GTAACAGGCCACTGCC | 86 | 1223 |
| 1157706 | 4027 | 4042 | 4227 | 4242 | CAACTTGGAAGTTGAT | 90 | 1224 |
| 1157739 | 4116 | 4131 | 4316 | 4331 | CTGGTACACCCAGTGG | 96 | 1225 |
| 1157773 | 4225 | 4240 | 4425 | 4440 | GGCCAGACCAACCCCC | 97 | 1226 |
| 1157806 | 4375 | 4390 | 4575 | 4590 | TCATTAAGCCACTTCC | 81 | 1227 |
| 1157840 | 4522 | 4537 | 4721 | 4736 | TTGAAGCATACCTTAA | 72 | 1228 |
| 1157873 | 4697 | 4712 | 4896 | 4911 | CTGGTTATGACTCAGA | 99 | 1229 |
| 1157905 | 4790 | 4805 | 4989 | 5004 | CCAATGGAGGTATGAC | 54 | 1230 |
| 1157939 | 4850 | 4865 | 5049 | 5064 | TTTGGCATATGCAGAT | 76 | 1231 |
| 1157973 | 4935 | 4950 | 5134 | 5149 | TTGTGGTTATAGCTTG | 32 | 1232 |
| 1158007 | 5093 | 5108 | 5292 | 5307 | TGATCCCAACTCATCT | 86 | 1233 |
| 1158039 | 5158 | 5173 | 5357 | 5372 | AACGAAGAGATACCTG | 88 | 1234 |
| 1158138 | 5418 | 5433 | 5617 | 5632 | AAGTGTACTATCCCAT | 49 | 1235 |
| 1158171 | 5536 | 5551 | 5735 | 5750 | TCCTTTCATAGAGCCT | 44 | 1236 |
| 1158205 | 5732 | 5747 | 5931 | 5946 | CCCCCCAAGATTGCCC | 86 | 1237 |
| 1158237 | 5798 | 5813 | 5997 | 6012 | CAAATCCTGATCTGGT | 76 | 1238 |
| 1158270‡ | 5931 | 5946 | 6130 | 6145 | CCTGTCTAAGAGGTTA | 79 | 1239 |
| 1158304 | 6015 | 6030 | 6214 | 6229 | ACTCTAATCACTGTCA | 65 | 1240 |
| 1158338 | 6105 | 6120 | 6304 | 6319 | TAAGGTCAATAGTGTA | 59 | 1241 |
| 1158371 | 6245 | 6260 | 6444 | 6459 | TCTCATACACTCACTA | 89 | 1242 |
| 1158404 | 6386 | 6401 | 6585 | 6600 | GACCTGAAGTCAAGAC | 101 | 1243 |
| 1158437 | 6472 | 6487 | 6671 | 6686 | TTAATCATACTCCAGT | 81 | 1244 |
| 1158470 | 6585 | 6600 | 6784 | 6799 | TCACAAATACGACTGC | 77 | 1245 |

TABLE 46-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158503 | 6788 | 6803 | 6987 | 7002 | GCACTAAAGATCACTG | 77 | 1246 |
| 1158534 | 6999 | 7014 | 7198 | 7213 | TTCTATAGTCTGAAGA | 86 | 1247 |
| 1158567 | 7103 | 7118 | 7302 | 7317 | ATACTATTGTCCCATA | 69 | 1248 |
| 1158599 | 7241 | 7256 | 7440 | 7455 | TAAGCCTTCGGTGCCT | 96 | 1249 |
| 1158633 | 7357 | 7372 | 7556 | 7571 | GAGGCAAGTCCTCATT | 89 | 1250 |
| 1158666 | 7473 | 7488 | 7672 | 7687 | GAGATTTGGGCTTTAT | 66 | 1251 |
| 1158700‡ | 7578 | 7593 | 7777 | 7792 | AGAGAAGTTGCTTGTG | 67 | 1252 |
| 1158734 | 7676 | 7691 | 7875 | 7890 | TTATGGATCATGCCCA | 72 | 1253 |
| 1158768 | 7727 | 7742 | 7926 | 7941 | ACATAGTTCAACCCAC | 82 | 1254 |
| 1158800 | 7803 | 7818 | 8002 | 8017 | TTATAATAGAGCTACT | 96 | 1255 |
| 1158833 | 7896 | 7911 | 8095 | 8110 | TACAAGTTACATGTTC | 80 | 1256 |
| 1158866 | 8011 | 8026 | 8210 | 8225 | TAAGATGCTAGCTTGG | 75 | 1257 |
| 1158900 | 8166 | 8181 | 8365 | 8380 | ACCAGGAGTGCCAACC | 92 | 1258 |
| 1158931 | 8271 | 8286 | 8470 | 8485 | CAAGAACTAGCACCTG | 93 | 1259 |
| 1158965 | 8355 | 8370 | 8554 | 8569 | AAGTCAAGCTCCTGAC | 96 | 1260 |
| 1158998 | 8501 | 8516 | N/A | N/A | ACAACAATTTAGAGCT | 89 | 1261 |

TABLE 47

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 105 | 18 |
| 559497 | 3629 | 3644 | 3829 | 3844 | AGTACTATAGCATCTG | 137 | 32 |
| 559564 | 2839 | 2854 | 3039 | 3054 | CCATAAGTAAGTTCCA | 54 | 36 |
| 568469 | 4523 | 4538 | 4722 | 4737 | TTTGAAGCATACCTTA | 101 | 1262 |
| 1156465 | 33 | 48 | N/A | N/A | CCCCAGTCCTTTACAG | 91 | 1263 |
| 1156498 | 215 | 230 | 181 | 196 | TATAAGGACAGCTAAG | 79 | 1264 |
| 1156531 | 321 | 336 | 287 | 302 | CTGAACCGGAGCAGGA | 113 | 1265 |
| 1156565 | 430 | 445 | 396 | 411 | AGTCAGGGACACACCC | 116 | 1266 |
| 1156599 | 509 | 524 | 475 | 490 | GCGAGTTCAAGTGGCC | 105 | 1267 |
| 1156633 | 577 | 592 | 543 | 558 | AATTTTTCTACCGTTT | 89 | 1268 |
| 1156667 | 630 | 645 | 596 | 611 | CACTCTGATCTGCGGC | 128 | 1269 |
| 1156700 | 767 | 782 | 733 | 748 | CGAGAAATCGGAGCAG | 78 | 1270 |
| 1156734 | 850 | 865 | 816 | 831 | GGCAAAATGGCGGACT | 114 | 1271 |

TABLE 47-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1156768 | 919 | 934 | 885 | 900 | TGTGATAGTTCAGGGC | 112 | 1272 |
| 1156802 | N/A | N/A | 961 | 976 | TACCTCTTAAAGCACT | 117 | 1273 |
| 1156836 | N/A | N/A | 1056 | 1071 | AAGATTTGAGCTGCAA | 101 | 1274 |
| 1156870 | N/A | N/A | 1178 | 1193 | CAAAAAGTAGTTCTTC | 118 | 1275 |
| 1156904 | 1033 | 1048 | 1233 | 1248 | AGAACAACTCGCATCA | 88 | 1276 |
| 1156938 | 1102 | 1117 | 1302 | 1317 | AGCAGAAGCCCCTGCG | 101 | 1277 |
| 1156972 | 1211 | 1226 | 1411 | 1426 | AATATCTTAGTAACCT | 81 | 1278 |
| 1157006 | 1423 | 1438 | 1623 | 1638 | CCCTTCTATTGGTATT | 93 | 1279 |
| 1157039 | 1541 | 1556 | 1741 | 1756 | ATCACCTTCGGTTTAA | 60 | 1280 |
| 1157072 | 1653 | 1668 | 1853 | 1868 | TCATCCTACCACTCCC | 66 | 1281 |
| 1157106 | 1964 | 1979 | 2164 | 2179 | CTATACTTCTCCAATA | 113 | 1282 |
| 1157140 | 2193 | 2208 | 2393 | 2408 | TAGTAGCTTTTTGATG | 69 | 1283 |
| 1157173 | 2316 | 2331 | 2516 | 2531 | ACTTCCGTTACGAAAG | 99 | 1284 |
| 1157206 | 2403 | 2418 | 2603 | 2618 | ATGCTAGTCCTCAGGA | 120 | 1285 |
| 1157240 | 2505 | 2520 | 2705 | 2720 | TCCTAGCTTCATCAAA | 93 | 1286 |
| 1157274 | 2589 | 2604 | 2789 | 2804 | TAGCTTCCTTCACCAA | 101 | 1287 |
| 1157307 | 2705 | 2720 | 2905 | 2920 | CGTGTGGTTGCCAAGC | 55 | 1288 |
| 1157341 | 2791 | 2806 | 2991 | 3006 | TTACCAACCACTCGCT | 98 | 1289 |
| 1157375 | 2871 | 2886 | 3071 | 3086 | CCCCATTATATTAGAA | 106 | 1290 |
| 1157409 | 2930 | 2945 | 3130 | 3145 | ACACCCGGAAATCGGC | 92 | 1291 |
| 1157442 | 3026 | 3041 | 3226 | 3241 | AACTTGCCATCTACTA | 118 | 1292 |
| 1157474 | 3169 | 3184 | 3369 | 3384 | CAGGTCATCTATTCAC | 49 | 1293 |
| 1157508 | 3279 | 3294 | 3479 | 3494 | CATATTTTGCCCCCAC | 85 | 1294 |
| 1157541 | 3377 | 3392 | 3577 | 3592 | TCTGATTATCCTGATA | 89 | 1295 |
| 1157574 | 3503 | 3518 | 3703 | 3718 | TAAAGTCTGATTAAGG | 96 | 1296 |
| 1157607 | 3652 | 3667 | 3852 | 3867 | CTTCTCTAACCCAGTT | 85 | 1297 |
| 1157640 | 3757 | 3772 | 3957 | 3972 | CTGCACTGTGCTGTAC | 105 | 1298 |
| 1157674 | 3909 | 3924 | 4109 | 4124 | CGTAACAGGCCACTGC | 98 | 1299 |
| 1157707 | 4028 | 4043 | 4228 | 4243 | CCAACTTGGAAGTTGA | 69 | 1300 |
| 1157740 | 4117 | 4132 | 4317 | 4332 | ACTGGTACACCCAGTG | 108 | 1301 |
| 1157774 | 4229 | 4244 | 4429 | 4444 | AGTAGGCCAGACCAAC | 96 | 1302 |
| 1157807 | 4376 | 4391 | 4576 | 4591 | ATCATTAAGCCACTTC | 47 | 1303 |
| 1157874 | 4698 | 4713 | 4897 | 4912 | GCTGGTTATGACTCAG | 91 | 1304 |
| 1157906 | 4791 | 4806 | 4990 | 5005 | CCCAATGGAGGTATGA | 77 | 1305 |
| 1157940 | 4876 | 4891 | 5075 | 5090 | TGGTAGCTTTCATTTG | 26 | 1306 |
| 1157974 | 4938 | 4953 | 5137 | 5152 | TTTTTGTGGTTATAGC | 25 | 1307 |

TABLE 47-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158008 | 5094 | 5109 | 5293 | 5308 | TTGATCCCAACTCATC | 67 | 1308 |
| 1158040 | 5159 | 5174 | 5358 | 5373 | TAACGAAGAGATACCT | 78 | 1309 |
| 1158073 | 5249 | 5264 | 5448 | 5463 | ACATGCAATACTGCAG | 97 | 1310 |
| 1158105 | 5340 | 5355 | 5539 | 5554 | TCCTGAAATCCCCTAG | 112 | 1311 |
| 1158139 | 5419 | 5434 | 5618 | 5633 | GAAGTGTACTATCCCA | 28 | 1312 |
| 1158172 | 5537 | 5552 | 5736 | 5751 | TTCCTTTCATAGAGCC | 30 | 1313 |
| 1158206 | 5733 | 5748 | 5932 | 5947 | CCCCCCCAAGATTGCC | 116 | 1314 |
| 1158238 | 5799 | 5814 | 5998 | 6013 | TCAAATCCTGATCTGG | 82 | 1315 |
| 1158271‡ | 5932 | 5947 | 6131 | 6146 | ACCTGTCTAAGAGGTT | 109 | 1316 |
| 1158305 | 6016 | 6031 | 6215 | 6230 | TACTCTAATCACTGTC | 85 | 1317 |
| 1158339 | 6106 | 6121 | 6305 | 6320 | ATAAGGTCAATAGTGT | 62 | 1318 |
| 1158372 | 6246 | 6261 | 6445 | 6460 | GTCTCATACACTCACT | 104 | 1319 |
| 1158405 | 6388 | 6403 | 6587 | 6602 | CAGACCTGAAGTCAAG | 86 | 1320 |
| 1158438 | 6473 | 6488 | 6672 | 6687 | TTTAATCATACTCCAG | 76 | 1321 |
| 1158471 | 6586 | 6601 | 6785 | 6800 | ATCACAAATACGACTG | 66 | 1322 |
| 1158504 | 6789 | 6804 | 6988 | 7003 | TGCACTAAAGATCACT | 63 | 1323 |
| 1158535 | 7000 | 7015 | 7199 | 7214 | CTTCTATAGTCTGAAG | 82 | 1324 |
| 1158568 | 7105 | 7120 | 7304 | 7319 | CAATACTATTGTCCCA | 53 | 1325 |
| 1158600 | 7243 | 7258 | 7442 | 7457 | TTTAAGCCTTCGGTGC | 87 | 1326 |
| 1158634 | 7358 | 7373 | 7557 | 7572 | TGAGGCAAGTCCTCAT | 95 | 1327 |
| 1158667 | 7476 | 7491 | 7675 | 7690 | CTTGAGATTTGGGCTT | 88 | 1328 |
| 1158701‡ | 7580 | 7595 | 7779 | 7794 | GCAGAGAAGTTGCTTG | 98 | 1329 |
| 1158735 | 7677 | 7692 | 7876 | 7891 | ATTATGGATCATGCCC | 83 | 1330 |
| 1158769 | 7728 | 7743 | 7927 | 7942 | AACATAGTTCAACCCA | 88 | 1331 |
| 1158801 | 7806 | 7821 | 8005 | 8020 | GTATTATAATAGAGCT | 96 | 1332 |
| 1158834 | 7897 | 7912 | 8096 | 8111 | CTACAAGTTACATGTT | 109 | 1333 |
| 1158867 | 8012 | 8027 | 8211 | 8226 | CTAAGATGCTAGCTTG | 126 | 1334 |
| 1158901 | 8167 | 8182 | 8366 | 8381 | AACCAGGAGTGCCAAC | 123 | 1335 |
| 1158932 | 8272 | 8287 | 8471 | 8486 | CCAAGAACTAGCACCT | 122 | 1336 |
| 1158966 | 8357 | 8372 | 8556 | 8571 | TCAAGTCAAGCTCCTG | 97 | 1337 |
| 1158999 | 8502 | 8517 | N/A | N/A | CACAACAATTTAGAGC | 117 | 1338 |

TABLE 48

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 85 | 18 |
| 559497 | 3629 | 3644 | 3829 | 3844 | AGTACTATAGCATCTG | 112 | 32 |
| 559564 | 2839 | 2854 | 3039 | 3054 | CCATAAGTAAGTTCCA | 60 | 36 |
| 1156466 | 34 | 49 | N/A | N/A | GCCCCAGTCCTTTACA | 97 | 1339 |
| 1156499 | 216 | 231 | 182 | 197 | CTATAAGGACAGCTAA | 96 | 1340 |
| 1156532 | 322 | 337 | 288 | 303 | TCTGAACCGGAGCAGG | 81 | 1341 |
| 1156566 | 434 | 449 | 400 | 415 | AGCCAGTCAGGGACAC | 103 | 1342 |
| 1156600 | 510 | 525 | 476 | 491 | AGCGAGTTCAAGTGGC | 73 | 1343 |
| 1156634 | 578 | 593 | 544 | 559 | AAATTTTCTACCGTT | 103 | 1344 |
| 1156668 | 633 | 648 | 599 | 614 | GCCCACTCTGATCTGC | 104 | 1345 |
| 1156701 | 769 | 784 | 735 | 750 | TTCGAGAAATCGGAGC | 111 | 1346 |
| 1156735 | 851 | 866 | 817 | 832 | TGGCAAAATGGCGGAC | 81 | 1347 |
| 1156769 | 920 | 935 | 886 | 901 | GTGTGATAGTTCAGGG | 92 | 1348 |
| 1156803 | N/A | N/A | 976 | 991 | CCGGAACTTTTAAAAT | 87 | 1349 |
| 1156837 | N/A | N/A | 1057 | 1072 | AAAGATTTGAGCTGCA | 104 | 1350 |
| 1156871 | N/A | N/A | 1180 | 1195 | GGCAAAAGTAGTTCT | 69 | 1351 |
| 1156905 | 1034 | 1049 | 1234 | 1249 | GAGAACAACTCGCATC | 80 | 1352 |
| 1156939 | 1110 | 1125 | 1310 | 1325 | GCCCCCTCAGCAGAAG | 75 | 1353 |
| 1156973 | 1212 | 1227 | 1412 | 1427 | CAATATCTTAGTAACC | 71 | 1354 |
| 1157007 | 1424 | 1439 | 1624 | 1639 | GCCCTTCTATTGGTAT | 103 | 1355 |
| 1157040 | 1542 | 1557 | 1742 | 1757 | AATCACCTTCGGTTTA | 101 | 1356 |
| 1157073 | 1655 | 1670 | 1855 | 1870 | TTTCATCCTACCACTC | 73 | 1357 |
| 1157107 | 1971 | 1986 | 2171 | 2186 | CTATCTTCTATACTTC | 76 | 1358 |
| 1157141 | 2194 | 2209 | 2394 | 2409 | TTAGTAGCTTTTGAT | 61 | 1359 |
| 1157174 | 2318 | 2333 | 2518 | 2533 | TTACTTCCGTTACGAA | 108 | 1360 |
| 1157207 | 2404 | 2419 | 2604 | 2619 | AATGCTAGTCCTCAGG | 43 | 1361 |
| 1157241 | 2506 | 2521 | 2706 | 2721 | GTCCTAGCTTCATCAA | 82 | 1362 |
| 1157275 | 2591 | 2606 | 2791 | 2806 | CCTAGCTTCCTTCACC | 83 | 1363 |
| 1157308 | 2708 | 2723 | 2908 | 2923 | CTCCGTGTGGTTGCCA | 76 | 1364 |
| 1157342 | 2792 | 2807 | 2992 | 3007 | TTTACCAACCACTCGC | 82 | 1365 |
| 1157376 | 2872 | 2887 | 3072 | 3087 | CCCCCATTATATTAGA | 72 | 1366 |
| 1157410 | 2931 | 2946 | 3131 | 3146 | AACACCCGGAAATCGG | 74 | 1367 |
| 1157443 | 3027 | 3042 | 3227 | 3242 | AAACTTGCCATCTACT | 104 | 1368 |
| 1157475 | 3171 | 3186 | 3371 | 3386 | AACAGGTCATCTATTC | 67 | 1369 |
| 1157509 | 3280 | 3295 | 3480 | 3495 | ACATATTTTGCCCCCA | 81 | 1370 |
| 1157542 | 3378 | 3393 | 3578 | 3593 | GTCTGATTATCCTGAT | 67 | 1371 |

TABLE 48-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157575 | 3510 | 3525 | 3710 | 3725 | GCACTTTTAAAGTCTG | 26 | 1372 |
| 1157608 | 3659 | 3674 | 3859 | 3874 | TACACTCCTTCTCTAA | 118 | 1373 |
| 1157641 | 3764 | 3779 | 3964 | 3979 | ACCAAAGCTGCACTGT | 85 | 1374 |
| 1157675 | 3910 | 3925 | 4110 | 4125 | CCGTAACAGGCCACTG | 70 | 1375 |
| 1157708 | 4029 | 4044 | 4229 | 4244 | GCCAACTTGGAAGTTG | 119 | 1376 |
| 1157741 | 4118 | 4133 | 4318 | 4333 | CACTGGTACACCCAGT | 85 | 1377 |
| 1157775 | 4230 | 4245 | 4430 | 4445 | CAGTAGGCCAGACCAA | 86 | 1378 |
| 1157808 | 4377 | 4392 | 4577 | 4592 | GATCATTAAGCCACTT | 90 | 1379 |
| 1157841 | 4526 | 4541 | 4725 | 4740 | ATTTTTGAAGCATACC | 59 | 1380 |
| 1157875 | 4699 | 4714 | 4898 | 4913 | GGCTGGTTATGACTCA | 60 | 1381 |
| 1157907 | 4792 | 4807 | 4991 | 5006 | CCCCAATGGAGGTATG | 63 | 1382 |
| 1157941 | 4878 | 4893 | 5077 | 5092 | ATTGGTAGCTTTCATT | 30 | 1383 |
| 1157975 | 4970 | 4985 | 5169 | 5184 | GCCTCTTCATTGTATT | 90 | 1384 |
| 1158009 | 5095 | 5110 | 5294 | 5309 | CTTGATCCCAACTCAT | 89 | 1385 |
| 1158041 | 5160 | 5175 | 5359 | 5374 | ATAACGAAGAGATACC | 94 | 1386 |
| 1158074 | 5251 | 5266 | 5450 | 5465 | TAACATGCAATACTGC | 82 | 1387 |
| 1158106 | 5341 | 5356 | 5540 | 5555 | ATCCTGAAATCCCCTA | 92 | 1388 |
| 1158140 | 5420 | 5435 | 5619 | 5634 | TGAAGTGTACTATCCC | 28 | 1389 |
| 1158173 | 5539 | 5554 | 5738 | 5753 | TATTCCTTTCATAGAG | 89 | 1390 |
| 1158207 | 5734 | 5749 | 5933 | 5948 | TCCCCCCCAAGATTGC | 103 | 1391 |
| 1158239 | 5800 | 5815 | 5999 | 6014 | CTCAAATCCTGATCTG | 63 | 1392 |
| 1158272‡ | 5936 | 5951 | 6135 | 6150 | TCCCACCTGTCTAAGA | 96 | 1393 |
| 1158306 | 6017 | 6032 | 6216 | 6231 | TTACTCTAATCACTGT | 67 | 1394 |
| 1158340 | 6107 | 6122 | 6306 | 6321 | TATAAGGTCAATAGTG | 62 | 1395 |
| 1158373 | 6251 | 6266 | 6450 | 6465 | GCAAGGTCTCATACAC | 52 | 1396 |
| 1158406 | 6407 | 6422 | 6606 | 6621 | TACTTGCCAACAGAAC | 81 | 1397 |
| 1158439 | 6475 | 6490 | 6674 | 6689 | CTTTTAATCATACTCC | 84 | 1398 |
| 1158472 | 6587 | 6602 | 6786 | 6801 | AATCACAAATACGACT | 77 | 1399 |
| 1158505 | 6790 | 6805 | 6989 | 7004 | ATGCACTAAAGATCAC | 66 | 1400 |
| 1158536 | 7002 | 7017 | 7201 | 7216 | TCCTTCTATAGTCTGA | 86 | 1401 |
| 1158569 | 7106 | 7121 | 7305 | 7320 | TCAATACTATTGTCCC | 34 | 1402 |
| 1158601 | 7244 | 7259 | 7443 | 7458 | CTTTAAGCCTTCGGTG | 103 | 1403 |
| 1158635 | 7359 | 7374 | 7558 | 7573 | TTGAGGCAAGTCCTCA | 97 | 1404 |
| 1158668 | 7478 | 7493 | 7677 | 7692 | CGCTTGAGATTTGGGC | 67 | 1405 |
| 1158702‡ | 7583 | 7598 | 7782 | 7797 | GTGGCAGAGAAGTTGC | 83 | 1406 |
| 1158736 | 7678 | 7693 | 7877 | 7892 | GATTATGGATCATGCC | 53 | 1407 |

TABLE 48-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158770 | 7729 | 7744 | 7928 | 7943 | TAACATAGTTCAACCC | 83 | 1408 |
| 1158802 | 7807 | 7822 | 8006 | 8021 | AGTATTATAATAGAGC | 80 | 1409 |
| 1158835 | 7898 | 7913 | 8097 | 8112 | TCTACAAGTTACATGT | 77 | 1410 |
| 1158868 | 8013 | 8028 | 8212 | 8227 | GCTAAGATGCTAGCTT | 90 | 1411 |
| 1158902 | 8169 | 8184 | 8368 | 8383 | GAAACCAGGAGTGCCA | 96 | 1412 |
| 1158933 | 8273 | 8288 | 8472 | 8487 | TCCAAGAACTAGCACC | 105 | 1413 |
| 1158967 | 8358 | 8373 | 8557 | 8572 | ATCAAGTCAAGCTCCT | 89 | 1414 |
| 1159000 | 8503 | 8518 | N/A | N/A | CCACAACAATTTAGAG | 127 | 1415 |

TABLE 49

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 110 | 18 |
| 559497 | 3629 | 3644 | 3829 | 3844 | AGTACTATAGCATCTG | 134 | 32 |
| 559564 | 2839 | 2854 | 3039 | 3054 | CCATAAGTAAGTTCCA | 60 | 36 |
| 568454 | 3028 | 3043 | 3228 | 3243 | CAAACTTGCCATCTAC | 89 | 1416 |
| 568459 | 3516 | 3531 | 3716 | 3731 | GGTTAAGCACTTTTAA | 62 | 1417 |
| 1156467 | 52 | 67 | 18 | 33 | GGAGAGGCCAGTTGCG | 110 | 1418 |
| 1156500 | 217 | 232 | 183 | 198 | CCTATAAGGACAGCTA | 85 | 1419 |
| 1156533 | 323 | 338 | 289 | 304 | TTCTGAACCGGAGCAG | 77 | 1420 |
| 1156567 | 443 | 458 | 409 | 424 | ACCTTGGGCAGCCAGT | 104 | 1421 |
| 1156601 | 511 | 526 | 477 | 492 | AAGCGAGTTCAAGTGG | 85 | 1422 |
| 1156635 | 580 | 595 | 546 | 561 | GGAAATTTTTCTACCG | 92 | 1423 |
| 1156669 | 640 | 655 | 606 | 621 | GCCAGTGGCCCACTCT | 108 | 1424 |
| 1156702 | 770 | 785 | 736 | 751 | GTTCGAGAAATCGGAG | 85 | 1425 |
| 1156736 | 852 | 867 | 818 | 833 | GTGGCAAAATGGCGGA | 79 | 1426 |
| 1156770 | 921 | 936 | 887 | 902 | AGTGTGATAGTTCAGG | 93 | 1427 |
| 1156804 | N/A | N/A | 977 | 992 | CCCGGAACTTTTAAAA | 107 | 1428 |
| 1156838 | N/A | N/A | 1058 | 1073 | GAAAGATTTGAGCTGC | 110 | 1429 |
| 1156872 | N/A | N/A | 1183 | 1198 | GGAGGCAAAAGTAGT | 91 | 1430 |
| 1156906 | 1035 | 1050 | 1235 | 1250 | GGAGAACAACTCGCAT | 83 | 1431 |
| 1156940 | 1126 | 1141 | 1326 | 1341 | TCCTCAAGCTCCGCCT | 77 | 1432 |
| 1156974 | 1213 | 1228 | 1413 | 1428 | GCAATATCTTAGTAAC | 77 | 1433 |
| 1157008 | 1426 | 1441 | 1626 | 1641 | TTGCCCTTCTATTGGT | 89 | 1434 |

TABLE 49-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157041 | 1544 | 1559 | 1744 | 1759 | TTAATCACCTTCGGTT | 73 | 1435 |
| 1157074 | 1659 | 1674 | 1859 | 1874 | ATTGTTTCATCCTACC | 78 | 1436 |
| 1157108 | 2008 | 2023 | 2208 | 2223 | CAGTGCTATTTTATCC | 22 | 1437 |
| 1157142 | 2200 | 2215 | 2400 | 2415 | GTCCTTTTAGTAGCTT | 50 | 1438 |
| 1157175 | 2319 | 2334 | 2519 | 2534 | ATTACTTCCGTTACGA | 57 | 1439 |
| 1157208 | 2405 | 2420 | 2605 | 2620 | TAATGCTAGTCCTCAG | 62 | 1440 |
| 1157242 | 2507 | 2522 | 2707 | 2722 | AGTCCTAGCTTCATCA | 73 | 1441 |
| 1157276 | 2631 | 2646 | 2831 | 2846 | CCTAGCTTCACCACCA | 67 | 1442 |
| 1157309 | 2710 | 2725 | 2910 | 2925 | TCCTCCGTGTGGTTGC | 82 | 1443 |
| 1157343 | 2793 | 2808 | 2993 | 3008 | TTTTACCAACCACTCG | 69 | 1444 |
| 1157377 | 2873 | 2888 | 3073 | 3088 | TCCCCCATTATATTAG | 86 | 1445 |
| 1157411 | 2932 | 2947 | 3132 | 3147 | CAACACCCGGAAATCG | 82 | 1446 |
| 1157476 | 3176 | 3191 | 3376 | 3391 | GTAAAAACAGGTCATC | 79 | 1447 |
| 1157510 | 3281 | 3296 | 3481 | 3496 | AACATATTTTGCCCCC | 78 | 1448 |
| 1157543 | 3386 | 3401 | 3586 | 3601 | CTGTGGTGGTCTGATT | 67 | 1449 |
| 1157609 | 3660 | 3675 | 3860 | 3875 | GTACACTCCTTCTCTA | 83 | 1450 |
| 1157642 | 3767 | 3782 | 3967 | 3982 | TGAACCAAAGCTGCAC | 98 | 1451 |
| 1157676 | 3911 | 3926 | 4111 | 4126 | ACCGTAACAGGCCACT | 80 | 1452 |
| 1157709 | 4030 | 4045 | 4230 | 4245 | TGCCAACTTGGAAGTT | 68 | 1453 |
| 1157742 | 4119 | 4134 | 4319 | 4334 | GCACTGGTACACCCAG | 109 | 1454 |
| 1157776 | 4231 | 4246 | 4431 | 4446 | CCAGTAGGCCAGACCA | 87 | 1455 |
| 1157809 | 4378 | 4393 | 4578 | 4593 | GGATCATTAAGCCACT | 85 | 1456 |
| 1157842 | 4580 | 4595 | 4779 | 4794 | TCTTAATCAGTTACAA | 91 | 1457 |
| 1157876 | 4701 | 4716 | 4900 | 4915 | CAGGCTGGTTATGACT | 74 | 1458 |
| 1157908 | 4793 | 4808 | 4992 | 5007 | TCCCCAATGGAGGTAT | 91 | 1459 |
| 1157942 | 4879 | 4894 | 5078 | 5093 | AATTGGTAGCTTTCAT | 36 | 1460 |
| 1157976 | 4974 | 4989 | 5173 | 5188 | CATTGCCTCTTCATTG | 64 | 1461 |
| 1158010 | 5097 | 5112 | 5296 | 5311 | CACTTGATCCCAACTC | 56 | 1462 |
| 1158042 | 5161 | 5176 | 5360 | 5375 | GATAACGAAGAGATAC | 81 | 1463 |
| 1158075 | 5252 | 5267 | 5451 | 5466 | CTAACATGCAATACTG | 99 | 1464 |
| 1158107 | 5343 | 5358 | 5542 | 5557 | CAATCCTGAAATCCCC | 84 | 1465 |
| 1158141 | 5422 | 5437 | 5621 | 5636 | AGTGAAGTGTACTATC | 56 | 1466 |
| 1158174 | 5540 | 5555 | 5739 | 5754 | CTATTCCTTTCATAGA | 111 | 1467 |
| 1158208 | 5735 | 5750 | 5934 | 5949 | ATCCCCCCAAGATTG | 95 | 1468 |
| 1158240 | 5802 | 5817 | 6001 | 6016 | CGCTCAAATCCTGATC | 77 | 1469 |
| 1158273 | 5938 | 5953 | 6137 | 6152 | TCTCCCACCTGTCTAA | 77 | 1470 |

TABLE 49-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158307 | 6018 | 6033 | 6217 | 6232 | ATTACTCTAATCACTG | 72 | 1471 |
| 1158341 | 6108 | 6123 | 6307 | 6322 | ATATAAGGTCAATAGT | 84 | 1472 |
| 1158374 | 6252 | 6267 | 6451 | 6466 | TGCAAGGTCTCATACA | 68 | 1473 |
| 1158407 | 6409 | 6424 | 6608 | 6623 | TTTACTTGCCAACAGA | 73 | 1474 |
| 1158440 | 6476 | 6491 | 6675 | 6690 | ACTTTTAATCATACTC | 79 | 1475 |
| 1158473 | 6588 | 6603 | 6787 | 6802 | CAATCACAAATACGAC | 82 | 1476 |
| 1158506 | 6792 | 6807 | 6991 | 7006 | CAATGCACTAAAGATC | 90 | 1477 |
| 1158537 | 7009 | 7024 | 7208 | 7223 | TGGAAGCTCCTTCTAT | 119 | 1478 |
| 1158570 | 7107 | 7122 | 7306 | 7321 | TTCAATACTATTGTCC | 42 | 1479 |
| 1158602 | 7245 | 7260 | 7444 | 7459 | ACTTTAAGCCTTCGGT | 87 | 1480 |
| 1158636 | 7360 | 7375 | 7559 | 7574 | GTTGAGGCAAGTCCTC | 97 | 1481 |
| 1158669 | 7479 | 7494 | 7678 | 7693 | CCGCTTGAGATTTGGG | 72 | 1482 |
| 1158703# | 7590 | 7605 | 7789 | 7804 | TGGCGATGTGGCAGAG | 65 | 1483 |
| 1158737 | 7679 | 7694 | 7878 | 7893 | CGATTATGGATCATGC | 56 | 1484 |
| 1158771 | 7730 | 7745 | 7929 | 7944 | CTAACATAGTTCAACC | 84 | 1485 |
| 1158803 | 7814 | 7829 | 8013 | 8028 | CTGGATAAGTATTATA | 72 | 1486 |
| 1158836 | 7899 | 7914 | 8098 | 8113 | GTCTACAAGTTACATG | 87 | 1487 |
| 1158869 | 8014 | 8029 | 8213 | 8228 | CGCTAAGATGCTAGCT | 106 | 1488 |
| 1158903 | 8171 | 8186 | 8370 | 8385 | TGGAAACCAGGAGTGC | 86 | 1489 |
| 1158934 | 8275 | 8290 | 8474 | 8489 | ACTCCAAGAACTAGCA | 89 | 1490 |
| 1158968 | 8359 | 8374 | 8558 | 8573 | AATCAAGTCAAGCTCC | 86 | 1491 |
| 1159001 | 8504 | 8519 | N/A | N/A | ACCACAACAATTTAGA | 110 | 1492 |

TABLE 50

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 87 | 18 |
| 559497 | 3629 | 3644 | 3829 | 3844 | AGTACTATAGCATCTG | 119 | 32 |
| 559564 | 2839 | 2854 | 3039 | 3054 | CCATAAGTAAGTTCCA | 36 | 36 |
| 1156468 | 64 | 79 | 30 | 45 | CTTAAGAGGGCAGGAG | 104 | 1493 |
| 1156501 | 218 | 233 | 184 | 199 | GCCTATAAGGACAGCT | 89 | 1494 |
| 1156534 | 324 | 339 | 290 | 305 | CTTCTGAACCGGAGCA | 127 | 1495 |
| 1156568 | 456 | 471 | 422 | 437 | CGAAGACACAGAGACC | 90 | 1496 |

TABLE 50-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1156602 | 512 | 527 | 478 | 493 | AAAGCGAGTTCAAGTG | 112 | 1497 |
| 1156636 | 581 | 596 | 547 | 562 | CGGAAATTTTTCTACC | 92 | 1498 |
| 1156670 | 649 | 664 | 615 | 630 | CCGTTGGCTGCCAGTG | 94 | 1499 |
| 1156703 | 771 | 786 | 737 | 752 | TGTTCGAGAAATCGGA | 83 | 1500 |
| 1156737 | 860 | 875 | 826 | 841 | GTTGAGAAGTGGCAAA | 80 | 1501 |
| 1156771 | 924 | 939 | 890 | 905 | TAAAGTGTGATAGTTC | 86 | 1502 |
| 1156805 | N/A | N/A | 978 | 993 | CCCCGGAACTTTTAAA | 77 | 1503 |
| 1156839 | N/A | N/A | 1061 | 1076 | GTGGAAAGATTTGAGC | 83 | 1504 |
| 1156873 | N/A | N/A | 1190 | 1205 | TTGTGAGGGAGGCAAA | 80 | 1505 |
| 1156907 | 1036 | 1051 | 1236 | 1251 | CGGAGAACAACTCGCA | 104 | 1506 |
| 1156941 | 1128 | 1143 | 1328 | 1343 | TTTCCTCAAGCTCCGC | 46 | 1507 |
| 1156975 | 1216 | 1231 | 1416 | 1431 | TAAGCAATATCTTAGT | 84 | 1508 |
| 1157009 | 1429 | 1444 | 1629 | 1644 | GCATTGCCCTTCTATT | 30 | 1509 |
| 1157042 | 1545 | 1560 | 1745 | 1760 | TTTAATCACCTTCGGT | 34 | 1510 |
| 1157075 | 1663 | 1678 | 1863 | 1878 | CCAAATTGTTTCATCC | 37 | 1511 |
| 1157109 | 2009 | 2024 | 2209 | 2224 | TCAGTGCTATTTTATC | 26 | 1512 |
| 1157143 | 2202 | 2217 | 2402 | 2417 | CAGTCCTTTTAGTAGC | 43 | 1513 |
| 1157176 | 2320 | 2335 | 2520 | 2535 | AATTACTTCCGTTACG | 57 | 1514 |
| 1157209 | 2406 | 2421 | 2606 | 2621 | TTAATGCTAGTCCTCA | 61 | 1515 |
| 1157243 | 2508 | 2523 | 2708 | 2723 | CAGTCCTAGCTTCATC | 91 | 1516 |
| 1157277 | 2632 | 2647 | 2832 | 2847 | TCCTAGCTTCACCACC | 56 | 1517 |
| 1157310 | 2712 | 2727 | 2912 | 2927 | CCTCCTCCGTGTGGTT | 68 | 1518 |
| 1157344 | 2794 | 2809 | 2994 | 3009 | TTTTTACCAACCACTC | 74 | 1519 |
| 1157378 | 2874 | 2889 | 3074 | 3089 | CTCCCCCATTATATTA | 69 | 1520 |
| 1157412 | 2934 | 2949 | 3134 | 3149 | TACAACACCCGGAAAT | 84 | 1521 |
| 1157444 | 3029 | 3044 | 3229 | 3244 | ACAAACTTGCCATCTA | 61 | 1522 |
| 1157477 | 3189 | 3204 | 3389 | 3404 | TCAGGGTGAGGAAGTA | 50 | 1523 |
| 1157511 | 3308 | 3323 | 3508 | 3523 | GACAGACCTAAGGGAA | 66 | 1524 |
| 1157544 | 3387 | 3402 | 3587 | 3602 | CCTGTGGTGGTCTGAT | 46 | 1525 |
| 1157576 | 3517 | 3532 | 3717 | 3732 | GGGTTAAGCACTTTTA | 43 | 1526 |
| 1157610 | 3662 | 3677 | 3862 | 3877 | CGGTACACTCCTTCTC | 60 | 1527 |
| 1157643 | 3769 | 3784 | 3969 | 3984 | TATGAACCAAAGCTGC | 93 | 1528 |
| 1157677 | 3912 | 3927 | 4112 | 4127 | AACCGTAACAGGCCAC | 50 | 1529 |
| 1157710 | 4034 | 4049 | 4234 | 4249 | TACTTGCCAACTTGGA | 49 | 1530 |
| 1157743 | 4121 | 4136 | 4321 | 4336 | ATGCACTGGTACACCC | 76 | 1531 |
| 1157777 | 4233 | 4248 | 4433 | 4448 | GCCCAGTAGGCCAGAC | 75 | 1532 |

TABLE 50-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157810 | 4380 | 4395 | 4580 | 4595 | CAGGATCATTAAGCCA | 58 | 1533 |
| 1157843 | 4586 | 4601 | 4785 | 4800 | CACAATTCTTAATCAG | 59 | 1534 |
| 1157877 | 4702 | 4717 | 4901 | 4916 | CCAGGCTGGTTATGAC | 56 | 1535 |
| 1157909 | 4795 | 4810 | 4994 | 5009 | ATTCCCCAATGGAGGT | 64 | 1536 |
| 1157943 | 4881 | 4896 | 5080 | 5095 | TAAATTGGTAGCTTTC | 26 | 1537 |
| 1157977 | 4977 | 4992 | 5176 | 5191 | GGACATTGCCTCTTCA | 46 | 1538 |
| 1158011 | 5098 | 5113 | 5297 | 5312 | CCACTTGATCCCAACT | 53 | 1539 |
| 1158043 | 5162 | 5177 | 5361 | 5376 | TGATAACGAAGAGATA | 85 | 1540 |
| 1158076 | 5253 | 5268 | 5452 | 5467 | CCTAACATGCAATACT | 88 | 1541 |
| 1158108 | 5360 | 5375 | 5559 | 5574 | TCGATGGAAAAATTTC | 70 | 1542 |
| 1158142 | 5423 | 5438 | 5622 | 5637 | GAGTGAAGTGTACTAT | 38 | 1543 |
| 1158175 | 5541 | 5556 | 5740 | 5755 | GCTATTCCTTTCATAG | 34 | 1544 |
| 1158209 | 5736 | 5751 | 5935 | 5950 | AATCCCCCCCAAGATT | 105 | 1545 |
| 1158241 | 5804 | 5819 | 6003 | 6018 | TCCGCTCAAATCCTGA | 74 | 1546 |
| 1158274 | 5939 | 5954 | 6138 | 6153 | ATCTCCCACCTGTCTA | 55 | 1547 |
| 1158308 | 6020 | 6035 | 6219 | 6234 | GTATTACTCTAATCAC | 66 | 1548 |
| 1158342 | 6109 | 6124 | 6308 | 6323 | TATATAAGGTCAATAG | 95 | 1549 |
| 1158375 | 6253 | 6268 | 6452 | 6467 | CTGCAAGGTCTCATAC | 76 | 1550 |
| 1158408 | 6410 | 6425 | 6609 | 6624 | ATTTACTTGCCAACAG | 53 | 1551 |
| 1158441 | 6485 | 6500 | 6684 | 6699 | GGGAACACAACTTTTA | 67 | 1552 |
| 1158474 | 6589 | 6604 | 6788 | 6803 | TCAATCACAAATACGA | 70 | 1553 |
| 1158507 | 6798 | 6813 | 6997 | 7012 | CATAAACAATGCACTA | 86 | 1554 |
| 1158538 | 7010 | 7025 | 7209 | 7224 | CTGGAAGCTCCTTCTA | 75 | 1555 |
| 1158571 | 7108 | 7123 | 7307 | 7322 | ATTCAATACTATTGTC | 76 | 1556 |
| 1158603 | 7246 | 7261 | 7445 | 7460 | TACTTTAAGCCTTCGG | 71 | 1557 |
| 1158637 | 7362 | 7377 | 7561 | 7576 | GAGTTGAGGCAAGTCC | 48 | 1558 |
| 1158670 | 7480 | 7495 | 7679 | 7694 | ACCGCTTGAGATTTGG | 68 | 1559 |
| 1158704‡ | 7591 | 7606 | 7790 | 7805 | GTGGCGATGTGGCAGA | 59 | 1560 |
| 1158738 | 7680 | 7695 | 7879 | 7894 | CCGATTATGGATCATG | 37 | 1561 |
| 1158772 | 7731 | 7746 | 7930 | 7945 | TCTAACATAGTTCAAC | 71 | 1562 |
| 1158804 | 7815 | 7830 | 8014 | 8029 | ACTGGATAAGTATTAT | 54 | 1563 |
| 1158837 | 7900 | 7915 | 8099 | 8114 | AGTCTACAAGTTACAT | 97 | 1564 |
| 1158870 | 8015 | 8030 | 8214 | 8229 | CCGCTAAGATGCTAGC | 80 | 1565 |
| 1158904 | 8176 | 8191 | 8375 | 8390 | CGTCCTGGAAACCAGG | 79 | 1566 |
| 1158935 | 8276 | 8291 | 8475 | 8490 | AACTCCAAGAACTAGC | 70 | 1567 |

TABLE 50-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158969 | 8360 | 8375 | 8559 | 8574 | CAATCAAGTCAAGCTC | 97 | 1568 |
| 1159002 | 8505 | 8520 | N/A | N/A | AACCACAACAATTTAG | 84 | 1569 |

TABLE 51

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 132 | 18 |
| 556131 | 8177 | 8192 | 8376 | 8391 | CCGTCCTGGAAACCAG | 84 | 1570 |
| 559497 | 3629 | 3644 | 3829 | 3844 | AGTACTATAGCATCTG | 119 | 32 |
| 559564 | 2839 | 2854 | 3039 | 3054 | CCATAAGTAAGTTCCA | 49 | 36 |
| 568477 | 5424 | 5439 | 5623 | 5638 | TGAGTGAAGTGTACTA | 58 | 1571 |
| 568491 | 6831 | 6846 | 7030 | 7045 | TTAAGACCAAGGGAGG | 71 | 1572 |
| 1156469 | 65 | 80 | 31 | 46 | GCTTAAGAGGGCAGGA | 107 | 1573 |
| 1156502 | 219 | 234 | 185 | 200 | AGCCTATAAGGACAGC | 77 | 1574 |
| 1156535 | 325 | 340 | 291 | 306 | CCTTCTGAACCGGAGC | 104 | 1575 |
| 1156569 | 457 | 472 | 423 | 438 | CCGAAGACACAGAGAC | 98 | 1576 |
| 1156603 | 513 | 528 | 479 | 494 | GAAAGCGAGTTCAAGT | 101 | 1577 |
| 1156637 | 582 | 597 | 548 | 563 | ACGGAAATTTTTCTAC | 96 | 1578 |
| 1156671 | 650 | 665 | 616 | 631 | GCCGTTGGCTGCCAGT | 108 | 1579 |
| 1156704 | 772 | 787 | 738 | 753 | TTGTTCGAGAAATCGG | 95 | 1580 |
| 1156738 | 862 | 877 | 828 | 843 | CGGTTGAGAAGTGGCA | 111 | 1581 |
| 1156772 | 925 | 940 | 891 | 906 | TTAAAGTGTGATAGTT | 94 | 1582 |
| 1156806 | N/A | N/A | 979 | 994 | CCCCCGGAACTTTTAA | 112 | 1583 |
| 1156840 | N/A | N/A | 1064 | 1079 | CGTGTGGAAAGATTTG | 100 | 1584 |
| 1156874 | N/A | N/A | 1193 | 1208 | CCTTTGTGAGGGAGGC | 105 | 1585 |
| 1156908 | 1037 | 1052 | 1237 | 1252 | ACGGAGAACAACTCGC | 99 | 1586 |
| 1156942 | 1129 | 1144 | 1329 | 1344 | GTTTCCTCAAGCTCCG | 41 | 1587 |
| 1156976 | 1217 | 1232 | 1417 | 1432 | CTAAGCAATATCTTAG | 85 | 1588 |
| 1157010 | 1431 | 1446 | 1631 | 1646 | AAGCATTGCCCTTCTA | 54 | 1589 |
| 1157043 | 1546 | 1561 | 1746 | 1761 | TTTTAATCACCTTCGG | 56 | 1590 |
| 1157076 | 1707 | 1722 | 1907 | 1922 | CGTACTTCTGTCTTCC | 36 | 1591 |
| 1157110 | 2033 | 2048 | 2233 | 2248 | GTTACCAATAATTTCC | 29 | 1592 |
| 1157144 | 2204 | 2219 | 2404 | 2419 | ACCAGTCCTTTTAGTA | 102 | 1593 |
| 1157177 | 2321 | 2336 | 2521 | 2536 | GAATTACTTCCGTTAC | 64 | 1594 |

TABLE 51-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157210 | 2407 | 2422 | 2607 | 2622 | ATTAATGCTAGTCCTC | 64 | 1595 |
| 1157244 | 2510 | 2525 | 2710 | 2725 | CTCAGTCCTAGCTTCA | 58 | 1596 |
| 1157278 | 2633 | 2648 | 2833 | 2848 | TTCCTAGCTTCACCAC | 64 | 1597 |
| 1157311 | 2713 | 2728 | 2913 | 2928 | GCCTCCTCCGTGTGGT | 101 | 1598 |
| 1157345 | 2796 | 2811 | 2996 | 3011 | GATTTTTACCAACCAC | 58 | 1599 |
| 1157379 | 2875 | 2890 | 3075 | 3090 | ACTCCCCCATTATATT | 98 | 1600 |
| 1157413 | 2935 | 2950 | 3135 | 3150 | CTACAACACCCGGAAA | 67 | 1601 |
| 1157445 | 3032 | 3047 | 3232 | 3247 | CCCACAAACTTGCCAT | 99 | 1602 |
| 1157478 | 3194 | 3209 | 3394 | 3409 | CGAATTCAGGGTGAGG | 32 | 1603 |
| 1157512 | 3309 | 3324 | 3509 | 3524 | AGACAGACCTAAGGGA | 79 | 1604 |
| 1157545 | 3391 | 3406 | 3591 | 3606 | TAAACCTGTGGTGGTC | 70 | 1605 |
| 1157577 | 3531 | 3546 | 3731 | 3746 | ATAACAAGTTTAAGGG | 59 | 1606 |
| 1157611 | 3663 | 3678 | 3863 | 3878 | GCGGTACACTCCTTCT | 72 | 1607 |
| 1157644 | 3776 | 3791 | 3976 | 3991 | GACTGAATATGAACCA | 49 | 1608 |
| 1157678 | 3913 | 3928 | 4113 | 4128 | CAACCGTAACAGGCCA | 77 | 1609 |
| 1157711 | 4035 | 4050 | 4235 | 4250 | TTACTTGCCAACTTGG | 30 | 1610 |
| 1157744 | 4123 | 4138 | 4323 | 4338 | TAATGCACTGGTACAC | 122 | 1611 |
| 1157778 | 4241 | 4256 | 4441 | 4456 | TAATGTCAGCCCAGTA | 93 | 1612 |
| 1157811 | 4381 | 4396 | 4581 | 4596 | TCAGGATCATTAAGCC | 63 | 1613 |
| 1157844 | 4591 | 4606 | 4790 | 4805 | ACTATCACAATTCTTA | 87 | 1614 |
| 1157878 | 4705 | 4720 | 4904 | 4919 | CTGCCAGGCTGGTTAT | 99 | 1615 |
| 1157910 | 4796 | 4811 | 4995 | 5010 | TATTCCCCAATGGAGG | 83 | 1616 |
| 1157944 | 4884 | 4899 | 5083 | 5098 | CTTTAAATTGGTAGCT | 55 | 1617 |
| 1157978 | 4978 | 4993 | 5177 | 5192 | TGGACATTGCCTCTTC | 71 | 1618 |
| 1158012 | 5099 | 5114 | 5298 | 5313 | TCCACTTGATCCCAAC | 53 | 1619 |
| 1158044 | 5163 | 5178 | 5362 | 5377 | CTGATAACGAAGAGAT | 103 | 1620 |
| 1158077 | 5254 | 5269 | 5453 | 5468 | CCCTAACATGCAATAC | 86 | 1621 |
| 1158109 | 5361 | 5376 | 5560 | 5575 | CTCGATGGAAAAATTT | 92 | 1622 |
| 1158176 | 5550 | 5565 | 5749 | 5764 | GCACATCATGCTATTC | 55 | 1623 |
| 1158210 | 5737 | 5752 | 5936 | 5951 | GAATCCCCCCCAAGAT | 115 | 1624 |
| 1158242 | 5805 | 5820 | 6004 | 6019 | TTCCGCTCAAATCCTG | 65 | 1625 |
| 1158275 | 5941 | 5956 | 6140 | 6155 | TAATCTCCCACCTGTC | 93 | 1626 |
| 1158309 | 6021 | 6036 | 6220 | 6235 | AGTATTACTCTAATCA | 77 | 1627 |
| 1158343 | 6110 | 6125 | 6309 | 6324 | CTATATAAGGTCAATA | 84 | 1628 |
| 1158376 | 6254 | 6269 | 6453 | 6468 | ACTGCAAGGTCTCATA | 101 | 1629 |
| 1158409 | 6412 | 6427 | 6611 | 6626 | GCATTTACTTGCCAAC | 89 | 1630 |

TABLE 51-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158442 | 6499 | 6514 | 6698 | 6713 | TACTCCAAGCATTGGG | 100 | 1631 |
| 1158475 | 6590 | 6605 | 6789 | 6804 | TTCAATCACAAATACG | 81 | 1632 |
| 1158539 | 7012 | 7027 | 7211 | 7226 | AACTGGAAGCTCCTTC | 83 | 1633 |
| 1158572 | 7115 | 7130 | 7314 | 7329 | GAAATCTATTCAATAC | 76 | 1634 |
| 1158604 | 7247 | 7262 | 7446 | 7461 | CTACTTTAAGCCTTCG | 69 | 1635 |
| 1158638 | 7363 | 7378 | 7562 | 7577 | GGAGTTGAGGCAAGTC | 59 | 1636 |
| 1158671 | 7481 | 7496 | 7680 | 7695 | CACCGCTTGAGATTTG | 53 | 1637 |
| 1158705‡ | 7607 | 7622 | 7806 | 7821 | GATCAAAAGGCACGGG | 70 | 1638 |
| 1158739 | 7681 | 7696 | 7880 | 7895 | ACCGATTATGGATCAT | 64 | 1639 |
| 1158773 | 7736 | 7751 | 7935 | 7950 | CCTTTTCTAACATAGT | 77 | 1640 |
| 1158805 | 7816 | 7831 | 8015 | 8030 | CACTGGATAAGTATTA | 60 | 1641 |
| 1158838 | 7901 | 7916 | 8100 | 8115 | CAGTCTACAAGTTACA | 73 | 1642 |
| 1158871 | 8016 | 8031 | 8215 | 8230 | TCCGCTAAGATGCTAG | 85 | 1643 |
| 1158936‡ | 8299 | 8314 | 8498 | 8513 | GCTGTTACCTCCCACC | 74 | 1644 |
| 1158970 | 8361 | 8376 | 8560 | 8575 | ACAATCAAGTCAAGCT | 85 | 1645 |
| 1159003 | 8506 | 8521 | N/A | N/A | GAACCACAACAATTTA | 81 | 1646 |

TABLE 52

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 116 | 18 |
| 559497 | 3629 | 3644 | 3829 | 3844 | AGTACTATAGCATCTG | 116 | 32 |
| 559564 | 2839 | 2854 | 3039 | 3054 | CCATAAGTAAGTTCCA | 36 | 36 |
| 946398 | 66 | 81 | 32 | 47 | CGCTTAAGAGGGCAGG | 88 | 1647 |
| 946402 | 1435 | 1450 | 1635 | 1650 | CTAAAAGCATTGCCCT | 65 | 1648 |
| 946413 | 5100 | 5115 | 5299 | 5314 | ATCCACTTGATCCCAA | 84 | 1649 |
| 1156503 | 220 | 235 | 186 | 201 | CAGCCTATAAGGACAG | 78 | 1650 |
| 1156536 | 326 | 341 | 292 | 307 | ACCTTCTGAACCGGAG | 78 | 1651 |
| 1156570 | 459 | 474 | 425 | 440 | CTCCGAAGACACAGAG | 103 | 1652 |
| 1156604 | 514 | 529 | 480 | 495 | GGAAAGCGAGTTCAAG | 76 | 1653 |
| 1156638 | 583 | 598 | 549 | 564 | CACGGAAATTTTTCTA | 92 | 1654 |
| 1156672 | 651 | 666 | 617 | 632 | GGCCGTTGGCTGCCAG | 79 | 1655 |
| 1156705 | 775 | 790 | 741 | 756 | TTTTTGTTCGAGAAAT | 107 | 1656 |

TABLE 52-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1156739 | 863 | 878 | 829 | 844 | ACGGTTGAGAAGTGGC | 78 | 1657 |
| 1156773 | 926 | 941 | 892 | 907 | ATTAAAGTGTGATAGT | 83 | 1658 |
| 1156807 | N/A | N/A | 980 | 995 | ACCCCCGGAACTTTTA | 91 | 1659 |
| 1156841 | N/A | N/A | 1078 | 1093 | ACTTAAATTACTAGCG | 110 | 1660 |
| 1156875 | N/A | N/A | 1194 | 1209 | GCCTTTGTGAGGGAGG | 123 | 1661 |
| 1156909 | 1039 | 1054 | 1239 | 1254 | AGACGGAGAACAACTC | 114 | 1662 |
| 1156943 | 1130 | 1145 | 1330 | 1345 | GGTTTCCTCAAGCTCC | 66 | 1663 |
| 1156977 | 1218 | 1233 | 1418 | 1433 | GCTAAGCAATATCTTA | 68 | 1664 |
| 1157044 | 1547 | 1562 | 1747 | 1762 | CTTTTAATCACCTTCG | 26 | 1665 |
| 1157077 | 1708 | 1723 | 1908 | 1923 | CCGTACTTCTGTCTTC | 36 | 1666 |
| 1157111 | 2034 | 2049 | 2234 | 2249 | GGTTACCAATAATTTC | 11 | 3 |
| 1157145 | 2208 | 2223 | 2408 | 2423 | TTACACCAGTCCTTTT | 63 | 1667 |
| 1157178 | 2322 | 2337 | 2522 | 2537 | TGAATTACTTCCGTTA | 64 | 1668 |
| 1157211 | 2408 | 2423 | 2608 | 2623 | AATTAATGCTAGTCCT | 84 | 1669 |
| 1157245 | 2515 | 2530 | 2715 | 2730 | TGCTCCTCAGTCCTAG | 74 | 1670 |
| 1157279 | 2635 | 2650 | 2835 | 2850 | TTTTCCTAGCTTCACC | 33 | 1671 |
| 1157312 | 2715 | 2730 | 2915 | 2930 | TCGCCTCCTCCGTGTG | 67 | 1672 |
| 1157346 | 2797 | 2812 | 2997 | 3012 | GGATTTTTACCAACCA | 86 | 1673 |
| 1157380 | 2876 | 2891 | 3076 | 3091 | AACTCCCCCATTATAT | 101 | 1674 |
| 1157414 | 2936 | 2951 | 3136 | 3151 | CCTACAACACCCGGAA | 100 | 1675 |
| 1157446 | 3033 | 3048 | 3233 | 3248 | ACCCACAAACTTGCCA | 102 | 1676 |
| 1157479 | 3197 | 3212 | 3397 | 3412 | AAACGAATTCAGGGTG | 77 | 1677 |
| 1157513 | 3311 | 3326 | 3511 | 3526 | CTAGACAGACCTAAGG | 98 | 1678 |
| 1157546 | 3392 | 3407 | 3592 | 3607 | GTAAACCTGTGGTGGT | 44 | 1679 |
| 1157578 | 3559 | 3574 | 3759 | 3774 | GACCATCCCAAAATGC | 92 | 1680 |
| 1157612 | 3664 | 3679 | 3864 | 3879 | AGCGGTACACTCCTTC | 50 | 1681 |
| 1157645 | 3777 | 3792 | 3977 | 3992 | TGACTGAATATGAACC | 59 | 1682 |
| 1157679 | 3914 | 3929 | 4114 | 4129 | CCAACCGTAACAGGCC | 73 | 1683 |
| 1157712 | 4036 | 4051 | 4236 | 4251 | GTTACTTGCCAACTTG | 37 | 1684 |
| 1157745 | 4124 | 4139 | 4324 | 4339 | TTAATGCACTGGTACA | 78 | 1685 |
| 1157779 | 4242 | 4257 | 4442 | 4457 | TTAATGTCAGCCCAGT | 63 | 1686 |
| 1157812 | 4382 | 4397 | 4582 | 4597 | TTCAGGATCATTAAGC | 82 | 1687 |
| 1157845 | 4593 | 4608 | 4792 | 4807 | GAACTATCACAATTCT | 97 | 1688 |
| 1157879 | 4710 | 4725 | 4909 | 4924 | TCATACTGCCAGGCTG | 71 | 1689 |
| 1157911 | 4797 | 4812 | 4996 | 5011 | TTATTCCCCAATGGAG | 82 | 1690 |
| 1157945 | 4885 | 4900 | 5084 | 5099 | ACTTTAAATTGGTAGC | 72 | 1691 |

TABLE 52-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157979 | 4979 | 4994 | 5178 | 5193 | ATGGACATTGCCTCTT | 63 | 1692 |
| 1158045 | 5164 | 5179 | 5363 | 5378 | TCTGATAACGAAGAGA | 79 | 1693 |
| 1158078 | 5255 | 5270 | 5454 | 5469 | TCCCTAACATGCAATA | 70 | 1694 |
| 1158110 | 5362 | 5377 | 5561 | 5576 | GCTCGATGGAAAAATT | 90 | 1695 |
| 1158143 | 5425 | 5440 | 5624 | 5639 | CTGAGTGAAGTGTACT | 52 | 1696 |
| 1158177 | 5551 | 5566 | 5750 | 5765 | AGCACATCATGCTATT | 74 | 1697 |
| 1158211 | 5739 | 5754 | 5938 | 5953 | AAGAATCCCCCCAAG | 72 | 1698 |
| 1158243 | 5807 | 5822 | 6006 | 6021 | TCTTCCGCTCAAATCC | 59 | 1699 |
| 1158276 | 5942 | 5957 | 6141 | 6156 | ATAATCTCCCACCTGT | 83 | 1700 |
| 1158310 | 6022 | 6037 | 6221 | 6236 | AAGTATTACTCTAATC | 91 | 1701 |
| 1158344 | 6112 | 6127 | 6311 | 6326 | CCCTATATAAGGTCAA | 87 | 1702 |
| 1158377 | 6255 | 6270 | 6454 | 6469 | CACTGCAAGGTCTCAT | 59 | 1703 |
| 1158410 | 6414 | 6429 | 6613 | 6628 | CTGCATTTACTTGCCA | 83 | 1704 |
| 1158443 | 6500 | 6515 | 6699 | 6714 | CTACTCCAAGCATTGG | 73 | 1705 |
| 1158476 | 6593 | 6608 | 6792 | 6807 | AGCTTCAATCACAAAT | 77 | 1706 |
| 1158508 | 6834 | 6849 | 7033 | 7048 | GAATTAAGACCAAGGG | 64 | 1707 |
| 1158540 | 7013 | 7028 | 7212 | 7227 | CAACTGGAAGCTCCTT | 77 | 1708 |
| 1158573 | 7118 | 7133 | 7317 | 7332 | GCTGAAATCTATTCAA | 259 | 1709 |
| 1158605 | 7248 | 7263 | 7447 | 7462 | CCTACTTTAAGCCTTC | 65 | 1710 |
| 1158639 | 7364 | 7379 | 7563 | 7578 | GGGAGTTGAGGCAAGT | 94 | 1711 |
| 1158672 | 7483 | 7498 | 7682 | 7697 | AGCACCGCTTGAGATT | 58 | 1712 |
| 1158706‡ | 7608 | 7623 | 7807 | 7822 | AGATCAAAAGGCACGG | 80 | 1713 |
| 1158740 | 7682 | 7697 | 7881 | 7896 | AACCGATTATGGATCA | 51 | 1714 |
| 1158774 | 7737 | 7752 | 7936 | 7951 | GCCTTTTCTAACATAG | 101 | 1715 |
| 1158806 | 7818 | 7833 | 8017 | 8032 | GTCACTGGATAAGTAT | 52 | 1716 |
| 1158839 | 7902 | 7917 | 8101 | 8116 | CCAGTCTACAAGTTAC | 50 | 1717 |
| 1158872 | 8017 | 8032 | 8216 | 8231 | TTCCGCTAAGATGCTA | 91 | 1718 |
| 1158905 | 8179 | 8194 | 8378 | 8393 | CCCCGTCCTGGAAACC | 79 | 1719 |
| 1158937 | 8300 | 8315 | 8499 | 8514 | TGCTGTTACCTCCCAC | 86 | 1720 |
| 1158971 | 8362 | 8377 | 8561 | 8576 | TACAATCAAGTCAAGC | 102 | 1721 |
| 1159004 | 8535 | 8550 | N/A | N/A | CCCCAATCAAGATTTT | 121 | 1722 |

TABLE 53

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 105 | 18 |
| 559497 | 3629 | 3644 | 3829 | 3844 | AGTACTATAGCATCTG | 117 | 32 |
| 559564 | 2839 | 2854 | 3039 | 3054 | CCATAAGTAAGTTCCA | 45 | 36 |
| 946406 | 2937 | 2952 | 3137 | 3152 | ACCTACAACACCCGGA | 75 | 1723 |
| 1156470 | 67 | 82 | 33 | 48 | GCGCTTAAGAGGGCAG | 94 | 1724 |
| 1156504 | 221 | 236 | 187 | 202 | CCAGCCTATAAGGACA | 101 | 1725 |
| 1156537 | 329 | 344 | 295 | 310 | CAGACCTTCTGAACCG | 90 | 1726 |
| 1156571 | 460 | 475 | 426 | 441 | TCTCCGAAGACACAGA | 100 | 1727 |
| 1156605 | 515 | 530 | 481 | 496 | TGGAAAGCGAGTTCAA | 104 | 1728 |
| 1156639 | 584 | 599 | 550 | 565 | GCACGGAAATTTTTCT | 103 | 1729 |
| 1156673 | 667 | 682 | 633 | 648 | CCGCCTGAGCCCCGGG | 109 | 1730 |
| 1156706 | 798 | 813 | 764 | 779 | CCAAGACAGCCACACG | 90 | 1731 |
| 1156740 | 864 | 879 | 830 | 845 | GACGGTTGAGAAGTGG | 75 | 1732 |
| 1156774 | 927 | 942 | 893 | 908 | GATTAAAGTGTGATAG | 84 | 1733 |
| 1156808 | N/A | N/A | 981 | 996 | AACCCCCGGAACTTTT | 99 | 1734 |
| 1156842 | N/A | N/A | 1079 | 1094 | TACTTAAATTACTAGC | 72 | 1735 |
| 1156876 | N/A | N/A | 1195 | 1210 | CGCCTTTGTGAGGGAG | 103 | 1736 |
| 1156910 | 1040 | 1055 | 1240 | 1255 | TAGACGGAGAACAACT | 71 | 1737 |
| 1156944 | 1132 | 1147 | 1332 | 1347 | GCGGTTTCCTCAAGCT | 80 | 1738 |
| 1156978 | 1219 | 1234 | 1419 | 1434 | CGCTAAGCAATATCTT | 42 | 1739 |
| 1157011 | 1436 | 1451 | 1636 | 1651 | TCTAAAAGCATTGCCC | 71 | 1740 |
| 1157045 | 1554 | 1569 | 1754 | 1769 | TCAAGGTCTTTTAATC | 59 | 1741 |
| 1157078 | 1710 | 1725 | 1910 | 1925 | TCCCGTACTTCTGTCT | 59 | 1742 |
| 1157112 | 2036 | 2051 | 2236 | 2251 | TTGGTTACCAATAATT | 76 | 1743 |
| 1157146 | 2209 | 2224 | 2409 | 2424 | ATTACACCAGTCCTTT | 60 | 1744 |
| 1157179 | 2323 | 2338 | 2523 | 2538 | TTGAATTACTTCCGTT | 46 | 1745 |
| 1157212 | 2409 | 2424 | 2609 | 2624 | CAATTAATGCTAGTCC | 72 | 1746 |
| 1157246 | 2519 | 2534 | 2719 | 2734 | CGCTTGCTCCTCAGTC | 38 | 1747 |
| 1157280 | 2654 | 2669 | 2854 | 2869 | CGCTCCTTCCTGGAAT | 119 | 1748 |
| 1157313 | 2716 | 2731 | 2916 | 2931 | CTCGCCTCCTCCGTGT | 90 | 1749 |
| 1157347 | 2798 | 2813 | 2998 | 3013 | CGGATTTTTACCAACC | 62 | 1750 |
| 1157381 | 2878 | 2893 | 3078 | 3093 | GAAACTCCCCCATTAT | 94 | 1751 |
| 1157447 | 3081 | 3096 | 3281 | 3296 | GGCTATCAAATTCATT | 58 | 1752 |
| 1157480 | 3198 | 3213 | 3398 | 3413 | AAAACGAATTCAGGGT | 75 | 1753 |
| 1157514 | 3312 | 3327 | 3512 | 3527 | TCTAGACAGACCTAAG | 106 | 1754 |
| 1157547 | 3393 | 3408 | 3593 | 3608 | TGTAAACCTGTGGTGG | 52 | 1755 |

TABLE 53-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157579 | 3562 | 3577 | 3762 | 3777 | TAAGACCATCCCAAAA | 84 | 1756 |
| 1157613 | 3665 | 3680 | 3865 | 3880 | CAGCGGTACACTCCTT | 64 | 1757 |
| 1157646 | 3786 | 3801 | 3986 | 4001 | CTCCTGAGATGACTGA | 61 | 1758 |
| 1157680 | 3915 | 3930 | 4115 | 4130 | CCCAACCGTAACAGGC | 78 | 1759 |
| 1157713 | 4037 | 4052 | 4237 | 4252 | AGTTACTTGCCAACTT | 93 | 1760 |
| 1157746 | 4125 | 4140 | 4325 | 4340 | ATTAATGCACTGGTAC | 84 | 1761 |
| 1157780 | 4243 | 4258 | 4443 | 4458 | GTTAATGTCAGCCCAG | 45 | 1762 |
| 1157813 | 4383 | 4398 | 4583 | 4598 | CTTCAGGATCATTAAG | 97 | 1763 |
| 1157846 | 4594 | 4609 | 4793 | 4808 | TGAACTATCACAATTC | 76 | 1764 |
| 1157880 | 4712 | 4727 | 4911 | 4926 | CATCATACTGCCAGGC | 41 | 1765 |
| 1157912 | 4799 | 4814 | 4998 | 5013 | GCTTATTCCCCAATGG | 27 | 1766 |
| 1157946 | 4888 | 4903 | 5087 | 5102 | GTAACTTTAAATTGGT | 45 | 1767 |
| 1157980 | 4980 | 4995 | 5179 | 5194 | GATGGACATTGCCTCT | 63 | 1768 |
| 1158013 | 5102 | 5117 | 5301 | 5316 | CAATCCACTTGATCCC | 44 | 1769 |
| 1158046 | 5165 | 5180 | 5364 | 5379 | TTCTGATAACGAAGAG | 92 | 1770 |
| 1158079 | 5256 | 5271 | 5455 | 5470 | ATCCCTAACATGCAAT | 77 | 1771 |
| 1158111 | 5363 | 5378 | 5562 | 5577 | GGCTCGATGGAAAAAT | 67 | 1772 |
| 1158144 | 5426 | 5441 | 5625 | 5640 | TCTGAGTGAAGTGTAC | 66 | 1773 |
| 1158178 | 5552 | 5567 | 5751 | 5766 | CAGCACATCATGCTAT | 85 | 1774 |
| 1158212 | 5740 | 5755 | 5939 | 5954 | GAAGAATCCCCCCCAA | 89 | 1775 |
| 1158244 | 5825 | 5840 | 6024 | 6039 | CCTTAAAGTTACATTC | 67 | 1776 |
| 1158277 | 5944 | 5959 | 6143 | 6158 | TCATAATCTCCCACCT | 90 | 1777 |
| 1158311 | 6051 | 6066 | 6250 | 6265 | GTTAACATGCAAACTT | 87 | 1778 |
| 1158345 | 6113 | 6128 | 6312 | 6327 | TCCCTATATAAGGTCA | 95 | 1779 |
| 1158378 | 6256 | 6271 | 6455 | 6470 | TCACTGCAAGGTCTCA | 52 | 1780 |
| 1158411 | 6415 | 6430 | 6614 | 6629 | ACTGCATTTACTTGCC | 92 | 1781 |
| 1158444 | 6501 | 6516 | 6700 | 6715 | ACTACTCCAAGCATTG | 64 | 1782 |
| 1158477 | 6594 | 6609 | 6793 | 6808 | CAGCTTCAATCACAAA | 67 | 1783 |
| 1158509 | 6838 | 6853 | 7037 | 7052 | GTAAGAATTAAGACCA | 63 | 1784 |
| 1158541 | 7015 | 7030 | 7214 | 7229 | TTCAACTGGAAGCTCC | 42 | 1785 |
| 1158574 | 7125 | 7140 | 7324 | 7339 | GCATAAAGCTGAAATC | 96 | 1786 |
| 1158606 | 7252 | 7267 | 7451 | 7466 | TTGTCCTACTTTAAGC | 70 | 1787 |
| 1158640 | 7366 | 7381 | 7565 | 7580 | GAGGGAGTTGAGGCAA | 76 | 1788 |
| 1158673 | 7484 | 7499 | 7683 | 7698 | AAGCACCGCTTGAGAT | 92 | 1789 |
| 1158707‡ | 7611 | 7626 | 7810 | 7825 | GCTAGATCAAAAGGCA | 87 | 1790 |
| 1158741 | 7683 | 7698 | 7882 | 7897 | AAACCGATTATGGATC | 97 | 1791 |

TABLE 53-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158775 | 7738 | 7753 | 7937 | 7952 | GGCCTTTTCTAACATA | 98 | 1792 |
| 1158807 | 7819 | 7834 | 8018 | 8033 | AGTCACTGGATAAGTA | 59 | 1793 |
| 1158840 | 7903 | 7918 | 8102 | 8117 | TCCAGTCTACAAGTTA | 69 | 1794 |
| 1158873 | 8021 | 8036 | 8220 | 8235 | CAGCTTCCGCTAAGAT | 111 | 1795 |
| 1158906 | 8182 | 8197 | 8381 | 8396 | GAACCCCGTCCTGGAA | 118 | 1796 |
| 1158938 | 8306 | 8321 | 8505 | 8520 | ATATTGTGCTGTTACC | 109 | 1797 |
| 1158972 | 8392 | 8407 | 8591 | 8606 | TTATATTAGGTTCTCG | 106 | 1798 |
| 1159005 | 8536 | 8551 | N/A | N/A | TCCCCAATCAAGATTT | 82 | 1799 |

TABLE 54

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 94 | 18 |
| 559497 | 3629 | 3644 | 3829 | 3844 | AGTACTATAGCATCTG | 114 | 32 |
| 559564 | 2839 | 2854 | 3039 | 3054 | CCATAAGTAAGTTCCA | 41 | 36 |
| 567919 | 6839 | 6854 | 7038 | 7053 | TGTAAGAATTAAGACC | 82 | 1800 |
| 567964 | 7016 | 7031 | 7215 | 7230 | ATTCAACTGGAAGCTC | 83 | 1801 |
| 946411 | 4244 | 4259 | 4444 | 4459 | AGTTAATGTCAGCCCA | 66 | 1802 |
| 946418 | 6502 | 6517 | 6701 | 6716 | CACTACTCCAAGCATT | 77 | 1803 |
| 946423 | 7749 | 7764 | 7948 | 7963 | GGCAAATTAATGGCCT | 75 | 1804 |
| 1156471 | 68 | 83 | 34 | 49 | TGCGCTTAAGAGGGCA | 93 | 1805 |
| 1156505 | 223 | 238 | 189 | 204 | GGCCAGCCTATAAGGA | 94 | 1806 |
| 1156538 | 330 | 345 | 296 | 311 | TCAGACCTTCTGAACC | 106 | 1807 |
| 1156572 | 461 | 476 | 427 | 442 | GTCTCCGAAGACACAG | 105 | 1808 |
| 1156606 | 516 | 531 | 482 | 497 | ATGGAAAGCGAGTTCA | 86 | 1809 |
| 1156640 | 585 | 600 | 551 | 566 | CGCACGGAAATTTTTC | 117 | 1810 |
| 1156674 | 668 | 683 | 634 | 649 | CCCGCCTGAGCCCCGG | 102 | 1811 |
| 1156707 | 807 | 822 | 773 | 788 | GACTTGCTCCCAAGAC | 93 | 1812 |
| 1156741 | 865 | 880 | 831 | 846 | GGACGGTTGAGAAGTG | 104 | 1813 |
| 1156775 | 928 | 943 | 894 | 909 | AGATTAAAGTGTGATA | 73 | 1814 |
| 1156809 | N/A | N/A | 982 | 997 | AAACCCCCGGAACTTT | 95 | 1815 |
| 1156843 | N/A | N/A | 1098 | 1113 | CAAACTACACATGCAG | 94 | 1816 |
| 1156877 | N/A | N/A | 1196 | 1211 | CCGCCTTTGTGAGGGA | 86 | 1817 |
| 1156911 | 1041 | 1056 | 1241 | 1256 | ATAGACGGAGAACAAC | 79 | 1818 |

TABLE 54-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1156945 | 1133 | 1148 | 1333 | 1348 | TGCGGTTTCCTCAAGC | 74 | 1819 |
| 1156979 | 1220 | 1235 | 1420 | 1435 | ACGCTAAGCAATATCT | 63 | 1820 |
| 1157012 | 1437 | 1452 | 1637 | 1652 | ATCTAAAAGCATTGCC | 82 | 1821 |
| 1157046 | 1562 | 1577 | 1762 | 1777 | CATGGATTTCAAGGTC | 89 | 1822 |
| 1157079 | 1712 | 1727 | 1912 | 1927 | CTTCCCGTACTTCTGT | 57 | 1823 |
| 1157113 | 2037 | 2052 | 2237 | 2252 | ATTGGTTACCAATAAT | 96 | 1824 |
| 1157147 | 2210 | 2225 | 2410 | 2425 | AATTACACCAGTCCTT | 58 | 1825 |
| 1157180 | 2324 | 2339 | 2524 | 2539 | CTTGAATTACTTCCGT | 44 | 1826 |
| 1157213 | 2410 | 2425 | 2610 | 2625 | TCAATTAATGCTAGTC | 65 | 1827 |
| 1157247 | 2521 | 2536 | 2721 | 2736 | CTCGCTTGCTCCTCAG | 46 | 1828 |
| 1157281 | 2657 | 2672 | 2857 | 2872 | ACTCGCTCCTTCCTGG | 52 | 1829 |
| 1157314 | 2717 | 2732 | 2917 | 2932 | GCTCGCCTCCTCCGTG | 73 | 1830 |
| 1157348 | 2799 | 2814 | 2999 | 3014 | ACGGATTTTTACCAAC | 66 | 1831 |
| 1157382 | 2879 | 2894 | 3079 | 3094 | CGAAACTCCCCCATTA | 85 | 1832 |
| 1157415 | 2938 | 2953 | 3138 | 3153 | AACCTACAACACCCGG | 66 | 1833 |
| 1157448 | 3089 | 3104 | 3289 | 3304 | CTCAATTTGGCTATCA | 40 | 1834 |
| 1157481 | 3199 | 3214 | 3399 | 3414 | CAAAACGAATTCAGGG | 74 | 1835 |
| 1157515 | 3313 | 3328 | 3513 | 3528 | TTCTAGACAGACCTAA | 71 | 1836 |
| 1157548 | 3394 | 3409 | 3594 | 3609 | CTGTAAACCTGTGGTG | 85 | 1837 |
| 1157580 | 3563 | 3578 | 3763 | 3778 | TTAAGACCATCCCAAA | 95 | 1838 |
| 1157614 | 3666 | 3681 | 3866 | 3881 | ACAGCGGTACACTCCT | 58 | 1839 |
| 1157647 | 3794 | 3809 | 3994 | 4009 | CTGAAGTTCTCCTGAG | 62 | 1840 |
| 1157681 | 3916 | 3931 | 4116 | 4131 | TCCCAACCGTAACAGG | 98 | 1841 |
| 1157714 | 4039 | 4054 | 4239 | 4254 | GGAGTTACTTGCCAAC | 76 | 1842 |
| 1157747 | 4126 | 4141 | 4326 | 4341 | AATTAATGCACTGGTA | 81 | 1843 |
| 1157814 | 4386 | 4401 | 4586 | 4601 | TCCCTTCAGGATCATT | 90 | 1844 |
| 1157847 | 4595 | 4610 | 4794 | 4809 | CTGAACTATCACAATT | 72 | 1845 |
| 1157881 | 4713 | 4728 | 4912 | 4927 | CCATCATACTGCCAGG | 83 | 1846 |
| 1157913 | 4800 | 4815 | 4999 | 5014 | TGCTTATTCCCCAATG | 48 | 1847 |
| 1157947 | 4889 | 4904 | 5088 | 5103 | CGTAACTTTAAATTGG | 21 | 1848 |
| 1157981 | 4981 | 4996 | 5180 | 5195 | AGATGGACATTGCCTC | 52 | 1849 |
| 1158014 | 5103 | 5118 | 5302 | 5317 | TCAATCCACTTGATCC | 86 | 1850 |
| 1158047 | 5166 | 5181 | 5365 | 5380 | CTTCTGATAACGAAGA | 105 | 1851 |
| 1158080 | 5258 | 5273 | 5457 | 5472 | TTATCCCTAACATGCA | 92 | 1852 |
| 1158112 | 5364 | 5379 | 5563 | 5578 | AGGCTCGATGGAAAAA | 72 | 1853 |
| 1158145 | 5469 | 5484 | 5668 | 5683 | CACTTTAGAGGCTTTT | 58 | 1854 |

TABLE 54-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158179 | 5555 | 5570 | 5754 | 5769 | TAACAGCACATCATGC | 79 | 1855 |
| 1158213 | 5741 | 5756 | 5940 | 5955 | AGAAGAATCCCCCCA | 113 | 1856 |
| 1158245 | 5826 | 5841 | 6025 | 6040 | GCCTTAAAGTTACATT | 90 | 1857 |
| 1158278 | 5945 | 5960 | 6144 | 6159 | ATCATAATCTCCCACC | 80 | 1858 |
| 1158312 | 6068 | 6083 | 6267 | 6282 | GATTGTAAGCATTTAA | 46 | 1859 |
| 1158346 | 6114 | 6129 | 6313 | 6328 | TTCCCTATATAAGGTC | 94 | 1860 |
| 1158379 | 6261 | 6276 | 6460 | 6475 | TAAACTCACTGCAAGG | 86 | 1861 |
| 1158412 | 6416 | 6431 | 6615 | 6630 | TACTGCATTTACTTGC | 80 | 1862 |
| 1158478 | 6601 | 6616 | 6800 | 6815 | ATGTACTCAGCTTCAA | 56 | 1863 |
| 1158575 | 7129 | 7144 | 7328 | 7343 | TCCAGCATAAAGCTGA | 109 | 1864 |
| 1158607 | 7258 | 7273 | 7457 | 7472 | CCATGGTTGTCCTACT | 90 | 1865 |
| 1158641 | 7367 | 7382 | 7566 | 7581 | AGAGGGAGTTGAGGCA | 60 | 1866 |
| 1158674 | 7486 | 7501 | 7685 | 7700 | TCAAGCACCGCTTGAG | 112 | 1867 |
| 1158708‡ | 7612 | 7627 | 7811 | 7826 | TGCTAGATCAAAAGGC | 92 | 1868 |
| 1158742 | 7684 | 7699 | 7883 | 7898 | GAAACCGATTATGGAT | 66 | 1869 |
| 1158808 | 7823 | 7838 | 8022 | 8037 | TTTTAGTCACTGGATA | 55 | 1870 |
| 1158841 | 7912 | 7927 | 8111 | 8126 | CCTATCTTCTCCAGTC | 113 | 1871 |
| 1158874 | 8023 | 8038 | 8222 | 8237 | ATCAGCTTCCGCTAAG | 96 | 1872 |
| 1158907 | 8183 | 8198 | 8382 | 8397 | TGAACCCGTCCTGGA | 97 | 1873 |
| 1158939 | 8307 | 8322 | 8506 | 8521 | GATATTGTGCTGTTAC | 117 | 1874 |
| 1158973 | 8393 | 8408 | 8592 | 8607 | GTTATATTAGGTTCTC | 93 | 1875 |
| 1159006 | 8538 | 8553 | N/A | N/A | TTTCCCCAATCAAGAT | 104 | 1876 |

TABLE 55

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 78 | 18 |
| 559497 | 3629 | 3644 | 3829 | 3844 | AGTACTATAGCATCTG | 112 | 32 |
| 559564 | 2839 | 2854 | 3039 | 3054 | CCATAAGTAAGTTCCA | 36 | 36 |
| 946412 | 4715 | 4730 | 4914 | 4929 | GGCCATCATACTGCCA | 119 | 1877 |
| 946425 | 8184 | 8199 | 8383 | 8398 | TTGAACCCGTCCTGG | 88 | 1878 |
| 1156472 | 69 | 84 | 35 | 50 | CTGCGCTTAAGAGGGC | 66 | 1879 |
| 1156506 | 228 | 243 | 194 | 209 | GGAATGGCCAGCCTAT | 83 | 1880 |

TABLE 55-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1156539 | 331 | 346 | 297 | 312 | TTCAGACCTTCTGAAC | 108 | 1881 |
| 1156573 | 469 | 484 | 435 | 450 | ATGGCTTTGTCTCCGA | 85 | 1882 |
| 1156607 | 517 | 532 | 483 | 498 | CATGGAAAGCGAGTTC | 80 | 1883 |
| 1156641 | 586 | 601 | 552 | 567 | CCGCACGGAAATTTTT | 85 | 1884 |
| 1156675 | 671 | 686 | 637 | 652 | CTCCCCGCCTGAGCCC | 123 | 1885 |
| 1156708 | 808 | 823 | 774 | 789 | CGACTTGCTCCCAAGA | 78 | 1886 |
| 1156742 | 866 | 881 | 832 | 847 | GGGACGGTTGAGAAGT | 93 | 1887 |
| 1156776 | 931 | 946 | 897 | 912 | GGAAGATTAAAGTGTG | 79 | 1888 |
| 1156810 | N/A | N/A | 983 | 998 | AAAACCCCGGAACTT | 91 | 1889 |
| 1156844 | N/A | N/A | 1106 | 1121 | CTTGAATGCAAACTAC | 106 | 1890 |
| 1156878 | N/A | N/A | 1197 | 1212 | GCCGCCTTTGTGAGGG | 75 | 1891 |
| 1156912 | 1042 | 1057 | 1242 | 1257 | TATAGACGGAGAACAA | 70 | 1892 |
| 1156946 | 1134 | 1149 | 1334 | 1349 | CTGCGGTTTCCTCAAG | 71 | 1893 |
| 1156980 | 1232 | 1247 | 1432 | 1447 | GTTAAAAACTTAACGC | 96 | 1894 |
| 1157013 | 1438 | 1453 | 1638 | 1653 | AATCTAAAAGCATTGC | 70 | 1895 |
| 1157047 | 1563 | 1578 | 1763 | 1778 | TCATGGATTTCAAGGT | 49 | 1896 |
| 1157080 | 1714 | 1729 | 1914 | 1929 | GCCTTCCCGTACTTCT | 40 | 1897 |
| 1157114 | 2040 | 2055 | 2240 | 2255 | TAAATTGGTTACCAAT | 75 | 1898 |
| 1157148 | 2211 | 2226 | 2411 | 2426 | AAATTACACCAGTCCT | 55 | 1899 |
| 1157181 | 2325 | 2340 | 2525 | 2540 | TCTTGAATTACTTCCG | 24 | 1900 |
| 1157214 | 2411 | 2426 | 2611 | 2626 | GTCAATTAATGCTAGT | 59 | 1901 |
| 1157248 | 2522 | 2537 | 2722 | 2737 | GCTCGCTTGCTCCTCA | 61 | 1902 |
| 1157282 | 2659 | 2674 | 2859 | 2874 | GCACTCGCTCCTTCCT | 34 | 1903 |
| 1157315 | 2718 | 2733 | 2918 | 2933 | TGCTCGCCTCCTCCGT | 66 | 1904 |
| 1157349 | 2800 | 2815 | 3000 | 3015 | CACGGATTTTTACCAA | 81 | 1905 |
| 1157383 | 2880 | 2895 | 3080 | 3095 | ACGAAACTCCCCCATT | 64 | 1906 |
| 1157416 | 2940 | 2955 | 3140 | 3155 | GAAACCTACAACACCC | 80 | 1907 |
| 1157449 | 3090 | 3105 | 3290 | 3305 | TCTCAATTTGGCTATC | 71 | 1908 |
| 1157482 | 3200 | 3215 | 3400 | 3415 | ACAAAACGAATTCAGG | 69 | 1909 |
| 1157516 | 3314 | 3329 | 3514 | 3529 | ATTCTAGACAGACCTA | 67 | 1910 |
| 1157549 | 3395 | 3410 | 3595 | 3610 | ACTGTAAACCTGTGGT | 106 | 1911 |
| 1157581 | 3564 | 3579 | 3764 | 3779 | GTTAAGACCATCCCAA | 81 | 1912 |
| 1157615 | 3667 | 3682 | 3867 | 3882 | CACAGCGGTACACTCC | 60 | 1913 |
| 1157648 | 3810 | 3825 | 4010 | 4025 | GCCTACTCAAGCTCTT | 80 | 1914 |
| 1157682 | 3917 | 3932 | 4117 | 4132 | ATCCCAACCGTAACAG | 87 | 1915 |
| 1157715 | 4040 | 4055 | 4240 | 4255 | GGGAGTTACTTGCCAA | 90 | 1916 |

TABLE 55-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157748 | 4128 | 4143 | 4328 | 4343 | CAAATTAATGCACTGG | 85 | 1917 |
| 1157781 | 4245 | 4260 | 4445 | 4460 | TAGTTAATGTCAGCCC | 59 | 1918 |
| 1157815 | 4387 | 4402 | 4587 | 4602 | ATCCCTTCAGGATCAT | 81 | 1919 |
| 1157848 | 4596 | 4611 | 4795 | 4810 | GCTGAACTATCACAAT | 73 | 1920 |
| 1157914 | 4801 | 4816 | 5000 | 5015 | ATGCTTATTCCCCAAT | 48 | 1921 |
| 1157948 | 4890 | 4905 | 5089 | 5104 | CCGTAACTTTAAATTG | 45 | 1922 |
| 1157982 | 4982 | 4997 | 5181 | 5196 | GAGATGGACATTGCCT | 42 | 1923 |
| 1158015 | 5104 | 5119 | 5303 | 5318 | CTCAATCCACTTGATC | 68 | 1924 |
| 1158048 | 5168 | 5183 | 5367 | 5382 | CTCTTCTGATAACGAA | 77 | 1925 |
| 1158081 | 5259 | 5274 | 5458 | 5473 | CTTATCCCTAACATGC | 59 | 1926 |
| 1158113 | 5365 | 5380 | 5564 | 5579 | AAGGCTCGATGGAAAA | 93 | 1927 |
| 1158146 | 5471 | 5486 | 5670 | 5685 | ATCACTTTAGAGGCTT | 47 | 1928 |
| 1158180 | 5556 | 5571 | 5755 | 5770 | CTAACAGCACATCATG | 68 | 1929 |
| 1158214 | 5742 | 5757 | 5941 | 5956 | GAGAAGAATCCCCCCC | 83 | 1930 |
| 1158246 | 5827 | 5842 | 6026 | 6041 | TGCCTTAAAGTTACAT | 81 | 1931 |
| 1158279 | 5946 | 5961 | 6145 | 6160 | GATCATAATCTCCCAC | 59 | 1932 |
| 1158313 | 6069 | 6084 | 6268 | 6283 | AGATTGTAAGCATTTA | 58 | 1933 |
| 1158347 | 6115 | 6130 | 6314 | 6329 | CTTCCCTATATAAGGT | 90 | 1934 |
| 1158380 | 6265 | 6280 | 6464 | 6479 | CTGATAAACTCACTGC | 52 | 1935 |
| 1158413 | 6419 | 6434 | 6618 | 6633 | CAGTACTGCATTTACT | 80 | 1936 |
| 1158445 | 6503 | 6518 | 6702 | 6717 | TCACTACTCCAAGCAT | 79 | 1937 |
| 1158479 | 6602 | 6617 | 6801 | 6816 | AATGTACTCAGCTTCA | 52 | 1938 |
| 1158510 | 6842 | 6857 | 7041 | 7056 | GCATGTAAGAATTAAG | 72 | 1939 |
| 1158542 | 7018 | 7033 | 7217 | 7232 | GAATTCAACTGGAAGC | 93 | 1940 |
| 1158576 | 7130 | 7145 | 7329 | 7344 | CTCCAGCATAAAGCTG | 88 | 1941 |
| 1158608 | 7259 | 7274 | 7458 | 7473 | TCCATGGTTGTCCTAC | 65 | 1942 |
| 1158642 | 7387 | 7402 | 7586 | 7601 | TCGGATGCTTCACTCC | 63 | 1943 |
| 1158675 | 7487 | 7502 | 7686 | 7701 | TTCAAGCACCGCTTGA | 88 | 1944 |
| 1158709‡ | 7613 | 7628 | 7812 | 7827 | GTGCTAGATCAAAAGG | 75 | 1945 |
| 1158743 | 7685 | 7700 | 7884 | 7899 | TGAAACCGATTATGGA | 97 | 1946 |
| 1158776 | 7750 | 7765 | 7949 | 7964 | AGGCAAATTAATGGCC | 92 | 1947 |
| 1158809 | 7824 | 7839 | 8023 | 8038 | GTTTTAGTCACTGGAT | 42 | 1948 |
| 1158842 | 7913 | 7928 | 8112 | 8127 | GCCTATCTTCTCCAGT | 73 | 1949 |
| 1158875 | 8027 | 8042 | 8226 | 8241 | GGAGATCAGCTTCCGC | 107 | 1950 |
| 1158940 | 8308 | 8323 | 8507 | 8522 | AGATATTGTGCTGTTA | 83 | 1951 |

TABLE 55-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158974 | 8394 | 8409 | 8593 | 8608 | AGTTATATTAGGTTCT | 78 | 1952 |
| 1159007 | 995 | 1010 | N/A | N/A | CGCCTCTTAAAGCACT | 112 | 1953 |

TABLE 56

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 82 | 18 |
| 559497 | 3629 | 3644 | 3829 | 3844 | AGTACTATAGCATCTG | 126 | 32 |
| 559564 | 2839 | 2854 | 3039 | 3054 | CCATAAGTAAGTTCCA | 49 | 36 |
| 946399 | 230 | 245 | 196 | 211 | CTGGAATGGCCAGCCT | 85 | 1954 |
| 946408 | 3668 | 3683 | 3868 | 3883 | GCACAGCGGTACACTC | 91 | 1955 |
| 946415 | 5743 | 5758 | 5942 | 5957 | AGAGAAGAATCCCCCC | 72 | 1956 |
| 1156473 | 71 | 86 | 37 | 52 | CGCTGCGCTTAAGAGG | 90 | 1957 |
| 1156540 | 338 | 353 | 304 | 319 | TATGAGCTTCAGACCT | 109 | 1958 |
| 1156574 | 473 | 488 | 439 | 454 | GCGAATGGCTTTGTCT | 93 | 1959 |
| 1156608 | 519 | 534 | 485 | 500 | GCCATGGAAAGCGAGT | 91 | 1960 |
| 1156642 | 587 | 602 | 553 | 568 | CCCGCACGGAAATTTT | 83 | 1961 |
| 1156676 | 672 | 687 | 638 | 653 | GCTCCCCGCCTGAGCC | 92 | 1962 |
| 1156709 | 810 | 825 | 776 | 791 | TGCGACTTGCTCCCAA | 113 | 1963 |
| 1156743 | 867 | 882 | 833 | 848 | AGGGACGGTTGAGAAG | 86 | 1964 |
| 1156777 | 945 | 960 | 911 | 926 | TACCACCTTTTGAAGG | 87 | 1965 |
| 1156811 | N/A | N/A | 984 | 999 | CAAAACCCCCGGAACT | 100 | 1966 |
| 1156845 | N/A | N/A | 1107 | 1122 | ACTTGAATGCAAACTA | 89 | 1967 |
| 1156879 | N/A | N/A | 1199 | 1214 | CCGCCGCCTTTGTGAG | 75 | 1968 |
| 1156913 | 1043 | 1058 | 1243 | 1258 | TTATAGACGGAGAACA | 92 | 1969 |
| 1156947 | 1135 | 1150 | 1335 | 1350 | TCTGCGGTTTCCTCAA | 51 | 1970 |
| 1156981 | 1233 | 1248 | 1433 | 1448 | CGTTAAAAACTTAACG | 87 | 1971 |
| 1157014 | 1458 | 1473 | 1658 | 1673 | GTTTAAGTCACCTTCA | 37 | 1972 |
| 1157048 | 1564 | 1579 | 1764 | 1779 | GTCATGGATTTCAAGG | 48 | 1973 |
| 1157081 | 1715 | 1730 | 1915 | 1930 | CGCCTTCCCGTACTTC | 43 | 1974 |
| 1157115 | 2061 | 2076 | 2261 | 2276 | TAAATTGATGGGCTTT | 63 | 1975 |
| 1157149 | 2212 | 2227 | 2412 | 2427 | TAAATTACACCAGTCC | 56 | 1976 |
| 1157182 | 2327 | 2342 | 2527 | 2542 | GATCTTGAATTACTTC | 51 | 1977 |
| 1157215 | 2412 | 2427 | 2612 | 2627 | TGTCAATTAATGCTAG | 58 | 1978 |

TABLE 56-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157249 | 2524 | 2539 | 2724 | 2739 | TTGCTCGCTTGCTCCT | 60 | 1979 |
| 1157283 | 2660 | 2675 | 2860 | 2875 | TGCACTCGCTCCTTCC | 67 | 1980 |
| 1157316 | 2719 | 2734 | 2919 | 2934 | CTGCTCGCCTCCTCCG | 84 | 1981 |
| 1157350 | 2801 | 2816 | 3001 | 3016 | TCACGGATTTTTACCA | 72 | 1982 |
| 1157384 | 2881 | 2896 | 3081 | 3096 | TACGAAACTCCCCCAT | 94 | 1983 |
| 1157417 | 2941 | 2956 | 3141 | 3156 | AGAAACCTACAACACC | 106 | 1984 |
| 1157450 | 3094 | 3109 | 3294 | 3309 | ATTGTCTCAATTTGGC | 37 | 1985 |
| 1157483 | 3201 | 3216 | 3401 | 3416 | TACAAAACGAATTCAG | 80 | 1986 |
| 1157517 | 3316 | 3331 | 3516 | 3531 | GGATTCTAGACAGACC | 56 | 1987 |
| 1157550 | 3396 | 3411 | 3596 | 3611 | AACTGTAAACCTGTGG | 108 | 1988 |
| 1157582 | 3565 | 3580 | 3765 | 3780 | TGTTAAGACCATCCCA | 91 | 1989 |
| 1157649 | 3811 | 3826 | 4011 | 4026 | GGCCTACTCAAGCTCT | 86 | 1990 |
| 1157683 | 3919 | 3934 | 4119 | 4134 | CAATCCCAACCGTAAC | 91 | 1991 |
| 1157716 | 4041 | 4056 | 4241 | 4256 | TGGGAGTTACTTGCCA | 81 | 1992 |
| 1157749 | 4129 | 4144 | 4329 | 4344 | CCAAATTAATGCACTG | 87 | 1993 |
| 1157782 | 4246 | 4261 | 4446 | 4461 | GTAGTTAATGTCAGCC | 41 | 1994 |
| 1157816 | 4388 | 4403 | 4588 | 4603 | AATCCCTTCAGGATCA | 92 | 1995 |
| 1157849 | 4597 | 4612 | 4796 | 4811 | AGCTGAACTATCACAA | 95 | 1996 |
| 1157882 | 4717 | 4732 | 4916 | 4931 | TAGGCCATCATACTGC | 94 | 1997 |
| 1157915 | 4803 | 4818 | 5002 | 5017 | TTATGCTTATTCCCCA | 25 | 1998 |
| 1157949 | 4891 | 4906 | 5090 | 5105 | TCCGTAACTTTAAATT | 64 | 1999 |
| 1157983 | 4983 | 4998 | 5182 | 5197 | TGAGATGGACATTGCC | 26 | 2000 |
| 1158016 | 5105 | 5120 | 5304 | 5319 | CCTCAATCCACTTGAT | 102 | 2001 |
| 1158049 | 5171 | 5186 | 5370 | 5385 | CAACTCTTCTGATAAC | 84 | 2002 |
| 1158082 | 5260 | 5275 | 5459 | 5474 | ACTTATCCCTAACATG | 87 | 2003 |
| 1158114 | 5367 | 5382 | 5566 | 5581 | AAAAGGCTCGATGGAA | 89 | 2004 |
| 1158147 | 5472 | 5487 | 5671 | 5686 | GATCACTTTAGAGGCT | 108 | 2005 |
| 1158181 | 5557 | 5572 | 5756 | 5771 | TCTAACAGCACATCAT | 78 | 2006 |
| 1158247 | 5829 | 5844 | 6028 | 6043 | CCTGCCTTAAAGTTAC | 80 | 2007 |
| 1158280 | 5947 | 5962 | 6146 | 6161 | TGATCATAATCTCCCA | 57 | 2008 |
| 1158314 | 6071 | 6086 | 6270 | 6285 | TAAGATTGTAAGCATT | 77 | 2009 |
| 1158348 | 6116 | 6131 | 6315 | 6330 | CCTTCCCTATATAAGG | 141 | 2010 |
| 1158381 | 6266 | 6281 | 6465 | 6480 | GCTGATAAACTCACTG | 45 | 2011 |
| 1158414 | 6421 | 6436 | 6620 | 6635 | AACAGTACTGCATTTA | 64 | 2012 |
| 1158446 | 6504 | 6519 | 6703 | 6718 | ATCACTACTCCAAGCA | 80 | 2013 |
| 1158480 | 6606 | 6621 | 6805 | 6820 | GCAAAATGTACTCAGC | 77 | 2014 |

TABLE 56-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158511 | 6846 | 6861 | 7045 | 7060 | TCCTGCATGTAAGAAT | 85 | 2015 |
| 1158543 | 7019 | 7034 | 7218 | 7233 | TGAATTCAACTGGAAG | 64 | 2016 |
| 1158577 | 7134 | 7149 | 7333 | 7348 | GTTACTCCAGCATAAA | 100 | 2017 |
| 1158609 | 7260 | 7275 | 7459 | 7474 | CTCCATGGTTGTCCTA | 61 | 2018 |
| 1158643 | 7388 | 7403 | 7587 | 7602 | TTCGGATGCTTCACTC | 52 | 2019 |
| 1158676 | 7488 | 7503 | 7687 | 7702 | CTTCAAGCACCGCTTG | 79 | 2020 |
| 1158710‡ | 7615 | 7630 | 7814 | 7829 | CTGTGCTAGATCAAAA | 72 | 2021 |
| 1158744 | 7686 | 7701 | 7885 | 7900 | TTGAAACCGATTATGG | 58 | 2022 |
| 1158777 | 7751 | 7766 | 7950 | 7965 | CAGGCAAATTAATGGC | 77 | 2023 |
| 1158810 | 7825 | 7840 | 8024 | 8039 | GGTTTTAGTCACTGGA | 15 | 2024 |
| 1158843 | 7920 | 7935 | 8119 | 8134 | CTCAAATGCCTATCTT | 81 | 2025 |
| 1158876 | 8028 | 8043 | 8227 | 8242 | TGGAGATCAGCTTCCG | 82 | 2026 |
| 1158908 | 8185 | 8200 | 8384 | 8399 | TTTGAACCCCGTCCTG | 94 | 2027 |
| 1158941 | 8309 | 8324 | 8508 | 8523 | AAGATATTGTGCTGTT | 87 | 2028 |
| 1158975 | 8395 | 8410 | 8594 | 8609 | CAGTTATATTAGGTTC | 92 | 2029 |
| 1159008 | 996 | 1011 | N/A | N/A | CCGCCTCTTAAAGCAC | 109 | 2030 |

TABLE 57

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 105 | 18 |
| 559497 | 3629 | 3644 | 3829 | 3844 | AGTACTATAGCATCTG | 123 | 32 |
| 559564 | 2839 | 2854 | 3039 | 3054 | CCATAAGTAAGTTCCA | 51 | 36 |
| 1156475 | 113 | 128 | 79 | 94 | GCTGAGGCTTCCCGGC | 85 | 2031 |
| 1156508 | 235 | 250 | 201 | 216 | ACCACCTGGAATGGCC | 85 | 2032 |
| 1156542 | 341 | 356 | 307 | 322 | AGGTATGAGCTTCAGA | 99 | 2033 |
| 1156576 | 475 | 490 | 441 | 456 | AAGCGAATGGCTTTGT | 94 | 2034 |
| 1156610 | 521 | 536 | 487 | 502 | TCGCCATGGAAAGCGA | 85 | 2035 |
| 1156644 | 590 | 605 | 556 | 571 | CGGCCCGCACGGAAAT | 76 | 2036 |
| 1156678 | 680 | 695 | 646 | 661 | ACAGAGCTGCTCCCCG | 82 | 2037 |
| 1156711 | 812 | 827 | 778 | 793 | CCTGCGACTTGCTCCC | 80 | 2038 |
| 1156745 | 870 | 885 | 836 | 851 | TGCAGGGACGGTTGAG | 122 | 2039 |
| 1156779 | 949 | 964 | 915 | 930 | AGTTTACCACCTTTTG | 77 | 2040 |

TABLE 57-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1156813 | N/A | N/A | 986 | 1001 | CACAAAACCCCCGGAA | 81 | 2041 |
| 1156847 | N/A | N/A | 1112 | 1127 | ATGGAACTTGAATGCA | 99 | 2042 |
| 1156881 | N/A | N/A | 1205 | 1220 | CACCTTCCGCCGCCTT | 125 | 2043 |
| 1156915 | 1045 | 1060 | 1245 | 1260 | ATTTATAGACGGAGAA | 91 | 2044 |
| 1156949 | 1138 | 1153 | 1338 | 1353 | TTATCTGCGGTTTCCT | 55 | 2045 |
| 1156983 | 1286 | 1301 | 1486 | 1501 | CTACTCTTCTAAGTCT | 51 | 2046 |
| 1157016 | 1460 | 1475 | 1660 | 1675 | CTGTTTAAGTCACCTT | 24 | 2047 |
| 1157050 | 1579 | 1594 | 1779 | 1794 | CGCAATTCTCCCTGCG | 77 | 2048 |
| 1157083 | 1718 | 1733 | 1918 | 1933 | CTTCGCCTTCCCGTAC | 65 | 2049 |
| 1157117 | 2063 | 2078 | 2263 | 2278 | ATTAAATTGATGGGCT | 80 | 2050 |
| 1157151 | 2239 | 2254 | 2439 | 2454 | CCAAAAGCCTTCTGCC | 66 | 2051 |
| 1157184 | 2334 | 2349 | 2534 | 2549 | TACTCTTGATCTTGAA | 54 | 2052 |
| 1157217 | 2415 | 2430 | 2615 | 2630 | AGCTGTCAATTAATGC | 90 | 2053 |
| 1157251 | 2536 | 2551 | 2736 | 2751 | ACGAACTGCTGCTTGC | 34 | 2054 |
| 1157285 | 2663 | 2678 | 2863 | 2878 | AATTGCACTCGCTCCT | 71 | 2055 |
| 1157318 | 2735 | 2750 | 2935 | 2950 | CCTCTACGCACAACGC | 41 | 2056 |
| 1157352 | 2803 | 2818 | 3003 | 3018 | CCTCACGGATTTTTAC | 101 | 2057 |
| 1157386 | 2883 | 2898 | 3083 | 3098 | AGTACGAAACTCCCCC | 72 | 2058 |
| 1157419 | 2960 | 2975 | 3160 | 3175 | GAGTATAAGCCTGAAA | 84 | 2059 |
| 1157452 | 3112 | 3127 | 3312 | 3327 | GCTTACAGATTTGCTG | 92 | 2060 |
| 1157485 | 3208 | 3223 | 3408 | 3423 | CTACATTTACAAAACG | 71 | 2061 |
| 1157519 | 3318 | 3333 | 3518 | 3533 | TAGGATTCTAGACAGA | 44 | 2062 |
| 1157552 | 3417 | 3432 | 3617 | 3632 | AGAACTGCTCTAGTTT | 106 | 2063 |
| 1157584 | 3567 | 3582 | 3767 | 3782 | CCTGTTAAGACCATCC | 60 | 2064 |
| 1157617 | 3672 | 3687 | 3872 | 3887 | AACAGCACAGCGGTAC | 98 | 2065 |
| 1157651 | 3813 | 3828 | 4013 | 4028 | TTGGCCTACTCAAGCT | 108 | 2066 |
| 1157685 | 3922 | 3937 | 4122 | 4137 | CACCAATCCCAACCGT | 95 | 2067 |
| 1157718 | 4043 | 4058 | 4243 | 4258 | ATTGGGAGTTACTTGC | 37 | 2068 |
| 1157751 | 4132 | 4147 | 4332 | 4347 | TGCCCAAATTAATGCA | 71 | 2069 |
| 1157784 | 4249 | 4264 | 4449 | 4464 | ATTGTAGTTAATGTCA | 50 | 2070 |
| 1157818 | 4398 | 4413 | 4598 | 4613 | CATCAGAAGAAATCCC | 83 | 2071 |
| 1157851 | 4602 | 4617 | 4801 | 4816 | ATTCAAGCTGAACTAT | 90 | 2072 |
| 1157884 | 4720 | 4735 | 4919 | 4934 | ATCTAGGCCATCATAC | 68 | 2073 |
| 1157917 | 4806 | 4821 | 5005 | 5020 | GGGTTATGCTTATTCC | 72 | 2074 |
| 1157951 | 4895 | 4910 | 5094 | 5109 | AGATTCCGTAACTTTA | 22 | 2075 |
| 1157985 | 5016 | 5031 | 5215 | 5230 | CGCTTTTATTCTGCTT | 94 | 2076 |

TABLE 57-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158018 | 5109 | 5124 | 5308 | 5323 | GCCTCCTCAATCCACT | 84 | 2077 |
| 1158051 | 5213 | 5228 | 5412 | 5427 | TTAACAGCTGCCTGCT | 44 | 2078 |
| 1158084 | 5262 | 5277 | 5461 | 5476 | GCACTTATCCCTAACA | 42 | 2079 |
| 1158116 | 5369 | 5384 | 5568 | 5583 | TAAAAAGGCTCGATGG | 61 | 2080 |
| 1158149 | 5476 | 5491 | 5675 | 5690 | CACTGATCACTTTAGA | 59 | 2081 |
| 1158183 | 5562 | 5577 | 5761 | 5776 | CTGATTCTAACAGCAC | 45 | 2082 |
| 1158216 | 5745 | 5760 | 5944 | 5959 | TTAGAGAAGAATCCCC | 69 | 2083 |
| 1158249 | 5870 | 5885 | 6069 | 6084 | ATTATATGCTCATCAC | 49 | 2084 |
| 1158282 | 5950 | 5965 | 6149 | 6164 | CTCTGATCATAATCTC | 65 | 2085 |
| 1158316 | 6073 | 6088 | 6272 | 6287 | TCTAAGATTGTAAGCA | 47 | 2086 |
| 1158350 | 6168 | 6183 | 6367 | 6382 | ATGAAATGCCTCTGCA | 87 | 2087 |
| 1158383 | 6270 | 6285 | 6469 | 6484 | GTATGCTGATAAACTC | 48 | 2088 |
| 1158416 | 6426 | 6441 | 6625 | 6640 | ATCAGAACAGTACTGC | 65 | 2089 |
| 1158448 | 6507 | 6522 | 6706 | 6721 | ACAATCACTACTCCAA | 69 | 2090 |
| 1158482 | 6669 | 6684 | 6868 | 6883 | AAGGCTTCAGTCCCCT | 86 | 2091 |
| 1158513 | 6853 | 6868 | 7052 | 7067 | TGAGTGTTCCTGCATG | 64 | 2092 |
| 1158545 | 7021 | 7036 | 7220 | 7235 | GGTGAATTCAACTGGA | 51 | 2093 |
| 1158579 | 7136 | 7151 | 7335 | 7350 | CAGTTACTCCAGCATA | 76 | 2094 |
| 1158611 | 7267 | 7282 | 7466 | 7481 | AGGAAGGCTCCATGGT | 89 | 2095 |
| 1158645 | 7390 | 7405 | 7589 | 7604 | CCTTCGGATGCTTCAC | 42 | 2096 |
| 1158678 | 7491 | 7506 | 7690 | 7705 | CCCCTTCAAGCACCGC | 86 | 2097 |
| 1158712‡ | 7622 | 7637 | 7821 | 7836 | GAAGGGTCTGTGCTAG | 60 | 2098 |
| 1158746 | 7688 | 7703 | 7887 | 7902 | CCTTGAAACCGATTAT | 64 | 2099 |
| 1158779 | 7753 | 7768 | 7952 | 7967 | TGCAGGCAAATTAATG | 89 | 2100 |
| 1158812 | 7835 | 7850 | 8034 | 8049 | GGTTTAAGTTGGTTTT | 10 | 2101 |
| 1158845 | 7925 | 7940 | 8124 | 8139 | AGCCACTCAAATGCCT | 72 | 2102 |
| 1158878 | 8032 | 8047 | 8231 | 8246 | GCATTGGAGATCAGCT | 89 | 2103 |
| 1158910 | 8187 | 8202 | 8386 | 8401 | GATTTGAACCCGTCC | 102 | 2104 |
| 1158943 | 8311 | 8326 | 8510 | 8525 | CAAAGATATTGTGCTG | 110 | 2105 |
| 1158977 | 8397 | 8412 | 8596 | 8611 | GGCAGTTATATTAGGT | 84 | 2106 |
| 1159010 | 998 | 1013 | N/A | N/A | CGCCGCCTCTTAAAGC | 87 | 2107 |

TABLE 58

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 113 | 18 |
| 556033 | 3320 | 3335 | 3520 | 3535 | TTTAGGATTCTAGACA | 75 | 2108 |
| 559497 | 3629 | 3644 | 3829 | 3844 | AGTACTATAGCATCTG | 124 | 32 |
| 559564 | 2839 | 2854 | 3039 | 3054 | CCATAAGTAAGTTCCA | 31 | 36 |
| 568503 | 7762 | 7777 | 7961 | 7976 | TTAACAATTTGCAGGC | 34 | 2109 |
| 946409 | 3936 | 3951 | 4136 | 4151 | ACCTAAACCCACCCCA | 101 | 2110 |
| 1156477 | 119 | 134 | 85 | 100 | AGGCGAGCTGAGGCTT | 81 | 2111 |
| 1156510 | 238 | 253 | 204 | 219 | ACCACCACCTGGAATG | 78 | 2112 |
| 1156544 | 343 | 358 | 309 | 324 | TTAGGTATGAGCTTCA | 82 | 2113 |
| 1156578 | 477 | 492 | 443 | 458 | CTAAGCGAATGGCTTT | 78 | 2114 |
| 1156612 | 524 | 539 | 490 | 505 | AAATCGCCATGGAAAG | 99 | 2115 |
| 1156646 | 592 | 607 | 558 | 573 | CACGGCCCGCACGGAA | 101 | 2116 |
| 1156680 | 698 | 713 | 664 | 679 | ACGCCTCAATCCCACA | 73 | 2117 |
| 1156713 | 815 | 830 | 781 | 796 | AGTCCTGCGACTTGCT | 74 | 2118 |
| 1156747 | 874 | 889 | 840 | 855 | GCCTTGCAGGGACGGT | 110 | 2119 |
| 1156781 | 951 | 966 | 917 | 932 | ATAGTTTACCACCTTT | 61 | 2120 |
| 1156815 | N/A | N/A | 988 | 1003 | CTCACAAAACCCCCGG | 82 | 2121 |
| 1156849 | N/A | N/A | 1114 | 1129 | TTATGGAACTTGAATG | 93 | 2122 |
| 1156883 | 1008 | 1023 | 1208 | 1223 | GATCACCTTCCGCCGC | 94 | 2123 |
| 1156917 | 1048 | 1063 | 1248 | 1263 | CGTATTTATAGACGGA | 109 | 2124 |
| 1156951 | 1140 | 1155 | 1340 | 1355 | ACTTATCTGCGGTTTC | 29 | 2125 |
| 1156985 | 1289 | 1304 | 1489 | 1504 | ATGCTACTCTTCTAAG | 60 | 2126 |
| 1157018 | 1467 | 1482 | 1667 | 1682 | CTTTAAGCTGTTTAAG | 104 | 2127 |
| 1157052 | 1582 | 1597 | 1782 | 1797 | TGACGCAATTCTCCCT | 67 | 2128 |
| 1157085 | 1726 | 1741 | 1926 | 1941 | ATTCTTTTCTTCGCCT | 52 | 2129 |
| 1157119 | 2077 | 2092 | 2277 | 2292 | CTGCACCACCAGAAAT | 80 | 2130 |
| 1157153 | 2271 | 2286 | 2471 | 2486 | TATTTAAGGCCTTCCA | 38 | 2131 |
| 1157186 | 2336 | 2351 | 2536 | 2551 | ATTACTCTTGATCTTG | 29 | 2132 |
| 1157219 | 2423 | 2438 | 2623 | 2638 | CCTGGGTCAGCTGTCA | 49 | 2133 |
| 1157253 | 2538 | 2553 | 2738 | 2753 | CCACGAACTGCTGCTT | 46 | 2134 |
| 1157287 | 2665 | 2680 | 2865 | 2880 | CAAATTGCACTCGCTC | 66 | 2135 |
| 1157320 | 2737 | 2752 | 2937 | 2952 | ATCCTCTACGCACAAC | 58 | 2136 |
| 1157354 | 2807 | 2822 | 3007 | 3022 | CCGACCTCACGGATTT | 61 | 2137 |
| 1157388 | 2885 | 2900 | 3085 | 3100 | TCAGTACGAAACTCCC | 59 | 2138 |
| 1157421 | 2962 | 2977 | 3162 | 3177 | ATGAGTATAAGCCTGA | 45 | 2139 |
| 1157454 | 3115 | 3130 | 3315 | 3330 | ACTGCTTACAGATTTG | 39 | 2140 |
| 1157487 | 3223 | 3238 | 3423 | 3438 | TTACACATCCAAACTC | 99 | 2141 |

TABLE 58-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157554 | 3419 | 3434 | 3619 | 3634 | TGAGAACTGCTCTAGT | 65 | 2142 |
| 1157586 | 3569 | 3584 | 3769 | 3784 | TCCCTGTTAAGACCAT | 73 | 2143 |
| 1157619 | 3675 | 3690 | 3875 | 3890 | GCCAACAGCACAGCGG | 92 | 2144 |
| 1157653 | 3817 | 3832 | 4017 | 4032 | ACATTTGGCCTACTCA | 54 | 2145 |
| 1157720 | 4045 | 4060 | 4245 | 4260 | TCATTGGGAGTTACTT | 43 | 2146 |
| 1157753 | 4143 | 4158 | 4343 | 4358 | GACACTTTCCTTGCCC | 52 | 2147 |
| 1157786 | 4254 | 4269 | 4454 | 4469 | CCATAATTGTAGTTAA | 93 | 2148 |
| 1157820 | 4404 | 4419 | 4604 | 4619 | AGCTACCATCAGAAGA | 66 | 2149 |
| 1157853 | 4604 | 4619 | 4803 | 4818 | ACATTCAAGCTGAACT | 105 | 2150 |
| 1157886 | 4724 | 4739 | 4923 | 4938 | CTGCATCTAGGCCATC | 35 | 2151 |
| 1157919 | 4808 | 4823 | 5007 | 5022 | CAGGGTTATGCTTATT | 25 | 2152 |
| 1157953 | 4897 | 4912 | 5096 | 5111 | GTAGATTCCGTAACTT | 27 | 2153 |
| 1157987 | 5018 | 5033 | 5217 | 5232 | TTCGCTTTTATTCTGC | 31 | 2154 |
| 1158020 | 5128 | 5143 | 5327 | 5342 | AACATTGGCACACAGC | 46 | 2155 |
| 1158053 | 5215 | 5230 | 5414 | 5429 | TGTTAACAGCTGCCTG | 61 | 2156 |
| 1158086 | 5264 | 5279 | 5463 | 5478 | AAGCACTTATCCCTAA | 75 | 2157 |
| 1158118 | 5371 | 5386 | 5570 | 5585 | TTTAAAAAGGCTCGAT | 72 | 2158 |
| 1158151 | 5481 | 5496 | 5680 | 5695 | CAAGGCACTGATCACT | 52 | 2159 |
| 1158185 | 5567 | 5582 | 5766 | 5781 | AACATCTGATTCTAAC | 73 | 2160 |
| 1158218 | 5767 | 5782 | 5966 | 5981 | CGCAGACAAAGTTTCT | 43 | 2161 |
| 1158251 | 5880 | 5895 | 6079 | 6094 | GCCTGGAATTATTATA | 69 | 2162 |
| 1158284 | 5952 | 5967 | 6151 | 6166 | TACTCTGATCATAATC | 83 | 2163 |
| 1158318 | 6075 | 6090 | 6274 | 6289 | ACTCTAAGATTGTAAG | 75 | 2164 |
| 1158352 | 6171 | 6186 | 6370 | 6385 | AGGATGAAATGCCTCT | 78 | 2165 |
| 1158385 | 6273 | 6288 | 6472 | 6487 | TGAGTATGCTGATAAA | 59 | 2166 |
| 1158418 | 6431 | 6446 | 6630 | 6645 | GCGGGATCAGAACAGT | 60 | 2167 |
| 1158450 | 6509 | 6524 | 6708 | 6723 | CAACAATCACTACTCC | 84 | 2168 |
| 1158484 | 6673 | 6688 | 6872 | 6887 | ACTAAAGGCTTCAGTC | 74 | 2169 |
| 1158515 | 6878 | 6893 | 7077 | 7092 | TGGCCCTTCGCATACG | 72 | 2170 |
| 1158547 | 7026 | 7041 | 7225 | 7240 | CCACTGGTGAATTCAA | 45 | 2171 |
| 1158581 | 7142 | 7157 | 7341 | 7356 | ACATGCCAGTTACTCC | 61 | 2172 |
| 1158613 | 7273 | 7288 | 7472 | 7487 | TGCCACAGGAAGGCTC | 110 | 2173 |
| 1158647 | 7392 | 7407 | 7591 | 7606 | TTCCTTCGGATGCTTC | 50 | 2174 |
| 1158680 | 7493 | 7508 | 7692 | 7707 | CTCCCCTTCAAGCACC | 96 | 2175 |
| 1158714 | 7642 | 7657 | 7841 | 7856 | GCTGCATCGAGGTGAG | 76 | 2176 |
| 1158748 | 7690 | 7705 | 7889 | 7904 | TACCTTGAAACCGATT | 64 | 2177 |

TABLE 58-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158814 | 7839 | 7854 | 8038 | 8053 | TACTGGTTTAAGTTGG | 33 | 2178 |
| 1158847 | 7938 | 7953 | 8137 | 8152 | CAAAAGCCCTCTCAGC | 114 | 2179 |
| 1158880 | 8034 | 8049 | 8233 | 8248 | GAGCATTGGAGATCAG | 71 | 2180 |
| 1158912 | 8189 | 8204 | 8388 | 8403 | GGGATTTGAACCCCGT | 101 | 2181 |
| 1158945 | 8322 | 8337 | 8521 | 8536 | TGTATATAGTTCAAAG | 91 | 2182 |
| 1158979 | 8402 | 8417 | 8601 | 8616 | GACAAGGCAGTTATAT | 99 | 2183 |
| 1159012 | 1001 | 1016 | N/A | N/A | TTCCGCCGCCTCTTAA | 78 | 2184 |

TABLE 59

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 92 | 18 |
| 559497 | 3629 | 3644 | 3829 | 3844 | AGTACTATAGCATCTG | 112 | 32 |
| 559564 | 2839 | 2854 | 3039 | 3054 | CCATAAGTAAGTTCCA | 37 | 36 |
| 1156476 | 114 | 129 | 80 | 95 | AGCTGAGGCTTCCCGG | 88 | 2185 |
| 1156509 | 236 | 251 | 202 | 217 | CACCACCTGGAATGGC | 92 | 2186 |
| 1156543 | 342 | 357 | 308 | 323 | TAGGTATGAGCTTCAG | 96 | 2187 |
| 1156577 | 476 | 491 | 442 | 457 | TAAGCGAATGGCTTTG | 93 | 2188 |
| 1156611 | 523 | 538 | 489 | 504 | AATCGCCATGGAAAGC | 104 | 2189 |
| 1156645 | 591 | 606 | 557 | 572 | ACGGCCCGCACGGAAA | 84 | 2190 |
| 1156679 | 696 | 711 | 662 | 677 | GCCTCAATCCCACACC | 98 | 2191 |
| 1156712 | 813 | 828 | 779 | 794 | TCCTGCGACTTGCTCC | 85 | 2192 |
| 1156746 | 871 | 886 | 837 | 852 | TTGCAGGGACGGTTGA | 110 | 2193 |
| 1156780 | 950 | 965 | 916 | 931 | TAGTTTACCACCTTTT | 85 | 2194 |
| 1156814 | N/A | N/A | 987 | 1002 | TCACAAAACCCCGGA | 84 | 2195 |
| 1156848 | N/A | N/A | 1113 | 1128 | TATGGAACTTGAATGC | 76 | 2196 |
| 1156882 | 1007 | 1022 | 1207 | 1222 | ATCACCTTCCGCCGCC | 85 | 2197 |
| 1156916 | 1047 | 1062 | 1247 | 1262 | GTATTTATAGACGGAG | 100 | 2198 |
| 1156950 | 1139 | 1154 | 1339 | 1354 | CTTATCTGCGGTTTCC | 38 | 2199 |
| 1156984 | 1288 | 1303 | 1488 | 1503 | TGCTACTCTTCTAAGT | 81 | 2200 |
| 1157017 | 1462 | 1477 | 1662 | 1677 | AGCTGTTTAAGTCACC | 38 | 2201 |
| 1157051 | 1581 | 1596 | 1781 | 1796 | GACGCAATTCTCCCTG | 73 | 2202 |
| 1157084 | 1720 | 1735 | 1920 | 1935 | TTCTTCGCCTTCCCGT | 34 | 2203 |
| 1157118 | 2064 | 2079 | 2264 | 2279 | AATTAAATTGATGGGC | 83 | 2204 |
| 1157152 | 2270 | 2285 | 2470 | 2485 | ATTTAAGGCCTTCCAA | 70 | 2205 |

TABLE 59-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157185 | 2335 | 2350 | 2535 | 2550 | TTACTCTTGATCTTGA | 34 | 2206 |
| 1157218 | 2422 | 2437 | 2622 | 2637 | CTGGGTCAGCTGTCAA | 67 | 2207 |
| 1157252 | 2537 | 2552 | 2737 | 2752 | CACGAACTGCTGCTTG | 45 | 2208 |
| 1157286 | 2664 | 2679 | 2864 | 2879 | AAATTGCACTCGCTCC | 72 | 2209 |
| 1157319 | 2736 | 2751 | 2936 | 2951 | TCCTCTACGCACAACG | 89 | 2210 |
| 1157353 | 2806 | 2821 | 3006 | 3021 | CGACCTCACGGATTTT | 84 | 2211 |
| 1157387 | 2884 | 2899 | 3084 | 3099 | CAGTACGAAACTCCCC | 70 | 2212 |
| 1157420 | 2961 | 2976 | 3161 | 3176 | TGAGTATAAGCCTGAA | 75 | 2213 |
| 1157453 | 3114 | 3129 | 3314 | 3329 | CTGCTTACAGATTTGC | 51 | 2214 |
| 1157486 | 3218 | 3233 | 3418 | 3433 | CATCCAAACTCTACAT | 77 | 2215 |
| 1157520 | 3319 | 3334 | 3519 | 3534 | TTAGGATTCTAGACAG | 57 | 2216 |
| 1157553 | 3418 | 3433 | 3618 | 3633 | GAGAACTGCTCTAGTT | 66 | 2217 |
| 1157585 | 3568 | 3583 | 3768 | 3783 | CCCTGTTAAGACCATC | 79 | 2218 |
| 1157618 | 3673 | 3688 | 3873 | 3888 | CAACAGCACAGCGGTA | 105 | 2219 |
| 1157652 | 3816 | 3831 | 4016 | 4031 | CATTTGGCCTACTCAA | 66 | 2220 |
| 1157686 | 3923 | 3938 | 4123 | 4138 | CCACCAATCCCAACCG | 74 | 2221 |
| 1157719 | 4044 | 4059 | 4244 | 4259 | CATTGGGAGTTACTTG | 68 | 2222 |
| 1157752 | 4141 | 4156 | 4341 | 4356 | CACTTTCCTTGCCCAA | 31 | 2223 |
| 1157785 | 4250 | 4265 | 4450 | 4465 | AATTGTAGTTAATGTC | 64 | 2224 |
| 1157819 | 4403 | 4418 | 4603 | 4618 | GCTACCATCAGAAGAA | 78 | 2225 |
| 1157852 | 4603 | 4618 | 4802 | 4817 | CATTCAAGCTGAACTA | 61 | 2226 |
| 1157885 | 4722 | 4737 | 4921 | 4936 | GCATCTAGGCCATCAT | 43 | 2227 |
| 1157918 | 4807 | 4822 | 5006 | 5021 | AGGGTTATGCTTATTC | 37 | 2228 |
| 1157952 | 4896 | 4911 | 5095 | 5110 | TAGATTCCGTAACTTT | 42 | 2229 |
| 1157986 | 5017 | 5032 | 5216 | 5231 | TCGCTTTTATTCTGCT | 78 | 2230 |
| 1158019 | 5126 | 5141 | 5325 | 5340 | CATTGGCACACAGCAC | 79 | 2231 |
| 1158052 | 5214 | 5229 | 5413 | 5428 | GTTAACAGCTGCCTGC | 93 | 2232 |
| 1158085 | 5263 | 5278 | 5462 | 5477 | AGCACTTATCCCTAAC | 60 | 2233 |
| 1158117 | 5370 | 5385 | 5569 | 5584 | TTAAAAGGCTCGATG | 79 | 2234 |
| 1158150 | 5477 | 5492 | 5676 | 5691 | GCACTGATCACTTTAG | 37 | 2235 |
| 1158184 | 5564 | 5579 | 5763 | 5778 | ATCTGATTCTAACAGC | 60 | 2236 |
| 1158217 | 5747 | 5762 | 5946 | 5961 | GATTAGAGAAGAATCC | 86 | 2237 |
| 1158250 | 5876 | 5891 | 6075 | 6090 | GGAATTATTATATGCT | 46 | 2238 |
| 1158283 | 5951 | 5966 | 6150 | 6165 | ACTCTGATCATAATCT | 65 | 2239 |
| 1158317 | 6074 | 6089 | 6273 | 6288 | CTCTAAGATTGTAAGC | 84 | 2240 |
| 1158351 | 6170 | 6185 | 6369 | 6384 | GGATGAAATGCCTCTG | 76 | 2241 |

TABLE 59-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158384 | 6272 | 6287 | 6471 | 6486 | GAGTATGCTGATAAAC | 63 | 2242 |
| 1158417 | 6430 | 6445 | 6629 | 6644 | CGGGATCAGAACAGTA | 76 | 2243 |
| 1158449 | 6508 | 6523 | 6707 | 6722 | AACAATCACTACTCCA | 74 | 2244 |
| 1158483 | 6672 | 6687 | 6871 | 6886 | CTAAAGGCTTCAGTCC | 77 | 2245 |
| 1158514 | 6855 | 6870 | 7054 | 7069 | GCTGAGTGTTCCTGCA | 78 | 2246 |
| 1158546 | 7022 | 7037 | 7221 | 7236 | TGGTGAATTCAACTGG | 67 | 2247 |
| 1158580 | 7141 | 7156 | 7340 | 7355 | CATGCCAGTTACTCCA | 67 | 2248 |
| 1158612 | 7269 | 7284 | 7468 | 7483 | ACAGGAAGGCTCCATG | 75 | 2249 |
| 1158646 | 7391 | 7406 | 7590 | 7605 | TCCTTCGGATGCTTCA | 44 | 2250 |
| 1158679 | 7492 | 7507 | 7691 | 7706 | TCCCCTTCAAGCACCG | 81 | 2251 |
| 1158713 | 7640 | 7655 | 7839 | 7854 | TGCATCGAGGTGAGGG | 79 | 2252 |
| 1158747 | 7689 | 7704 | 7888 | 7903 | ACCTTGAAACCGATTA | 55 | 2253 |
| 1158780 | 7761 | 7776 | 7960 | 7975 | TAACAATTTGCAGGCA | 40 | 2254 |
| 1158813 | 7837 | 7852 | 8036 | 8051 | CTGGTTTAAGTTGGTT | 39 | 2255 |
| 1158846 | 7935 | 7950 | 8134 | 8149 | AAGCCCTCTCAGCCAC | 62 | 2256 |
| 1158879 | 8033 | 8048 | 8232 | 8247 | AGCATTGGAGATCAGC | 64 | 2257 |
| 1158911 | 8188 | 8203 | 8387 | 8402 | GGATTTGAACCCCGTC | 70 | 2258 |
| 1158944 | 8314 | 8329 | 8513 | 8528 | GTTCAAAGATATTGTG | 100 | 2259 |
| 1158978 | 8398 | 8413 | 8597 | 8612 | AGGCAGTTATATTAGG | 74 | 2260 |
| 1159011 | 1000 | 1015 | N/A | N/A | TCCGCCGCCTCTTAAA | 74 | 2261 |

TABLE 60

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 83 | 18 |
| 559497 | 3629 | 3644 | 3829 | 3844 | AGTACTATAGCATCTG | 99 | 32 |
| 559564 | 2839 | 2854 | 3039 | 3054 | CCATAAGTAAGTTCCA | 27 | 36 |
| 1156474 | 99 | 114 | 65 | 80 | GCGCCGGGCTTCTGCG | 71 | 2262 |
| 1156507 | 232 | 247 | 198 | 213 | ACCTGGAATGGCCAGC | 79 | 2263 |
| 1156541 | 339 | 354 | 305 | 320 | GTATGAGCTTCAGACC | 106 | 2264 |
| 1156575 | 474 | 489 | 440 | 455 | AGCGAATGGCTTTGTC | 95 | 2265 |
| 1156609 | 520 | 535 | 486 | 501 | CGCCATGGAAAGCGAG | 80 | 2266 |
| 1156643 | 588 | 603 | 554 | 569 | GCCCGCACGGAAATTT | 77 | 2267 |
| 1156677 | 673 | 688 | 639 | 654 | TGCTCCCCGCCTGAGC | 76 | 2268 |
| 1156710 | 811 | 826 | 777 | 792 | CTGCGACTTGCTCCCA | 90 | 2269 |

TABLE 60-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1156744 | 869 | 884 | 835 | 850 | GCAGGGACGGTTGAGA | 92 | 2270 |
| 1156778 | 948 | 963 | 914 | 929 | GTTTACCACCTTTTGA | 97 | 2271 |
| 1156812 | N/A | N/A | 985 | 1000 | ACAAAACCCCCGGAAC | 253 | 2272 |
| 1156846 | N/A | N/A | 1111 | 1126 | TGGAACTTGAATGCAA | 90 | 2273 |
| 1156880 | N/A | N/A | 1203 | 1218 | CCTTCCGCCGCCTTTG | 79 | 2274 |
| 1156914 | 1044 | 1059 | 1244 | 1259 | TTTATAGACGGAGAAC | 106 | 2275 |
| 1156948 | 1136 | 1151 | 1336 | 1351 | ATCTGCGGTTTCCTCA | 42 | 2276 |
| 1156982 | 1247 | 1262 | 1447 | 1462 | AGCTATTAAAATTACG | 78 | 2277 |
| 1157015 | 1459 | 1474 | 1659 | 1674 | TGTTTAAGTCACCTTC | 26 | 2278 |
| 1157049 | 1565 | 1580 | 1765 | 1780 | CGTCATGGATTTCAAG | 60 | 2279 |
| 1157082 | 1717 | 1732 | 1917 | 1932 | TTCGCCTTCCCGTACT | 37 | 2280 |
| 1157116 | 2062 | 2077 | 2262 | 2277 | TTAAATTGATGGGCTT | 78 | 2281 |
| 1157150 | 2213 | 2228 | 2413 | 2428 | TTAAATTACACCAGTC | 50 | 2282 |
| 1157183 | 2333 | 2348 | 2533 | 2548 | ACTCTTGATCTTGAAT | 57 | 2283 |
| 1157216 | 2414 | 2429 | 2614 | 2629 | GCTGTCAATTAATGCT | 76 | 2284 |
| 1157250 | 2535 | 2550 | 2735 | 2750 | CGAACTGCTGCTTGCT | 60 | 2285 |
| 1157284 | 2661 | 2676 | 2861 | 2876 | TTGCACTCGCTCCTTC | 67 | 2286 |
| 1157317 | 2721 | 2736 | 2921 | 2936 | GCCTGCTCGCCTCCTC | 59 | 2287 |
| 1157351 | 2802 | 2817 | 3002 | 3017 | CTCACGGATTTTTACC | 93 | 2288 |
| 1157385 | 2882 | 2897 | 3082 | 3097 | GTACGAAACTCCCCCA | 62 | 2289 |
| 1157418 | 2942 | 2957 | 3142 | 3157 | GAGAAACCTACAACAC | 89 | 2290 |
| 1157451 | 3100 | 3115 | 3300 | 3315 | GCTGAAATTGTCTCAA | 55 | 2291 |
| 1157484 | 3202 | 3217 | 3402 | 3417 | TTACAAAACGAATTCA | 90 | 2292 |
| 1157518 | 3317 | 3332 | 3517 | 3532 | AGGATTCTAGACAGAC | 28 | 2293 |
| 1157551 | 3411 | 3426 | 3611 | 3626 | GCTCTAGTTTCTATAA | 73 | 2294 |
| 1157583 | 3566 | 3581 | 3766 | 3781 | CTGTTAAGACCATCCC | 54 | 2295 |
| 1157616 | 3670 | 3685 | 3870 | 3885 | CAGCACAGCGGTACAC | 93 | 2296 |
| 1157650 | 3812 | 3827 | 4012 | 4027 | TGGCCTACTCAAGCTC | 108 | 2297 |
| 1157684 | 3921 | 3936 | 4121 | 4136 | ACCAATCCCAACCGTA | 82 | 2298 |
| 1157717 | 4042 | 4057 | 4242 | 4257 | TTGGGAGTTACTTGCC | 30 | 2299 |
| 1157750 | 4130 | 4145 | 4330 | 4345 | CCCAAATTAATGCACT | 49 | 2300 |
| 1157783 | 4247 | 4262 | 4447 | 4462 | TGTAGTTAATGTCAGC | 33 | 2301 |
| 1157817 | 4390 | 4405 | 4590 | 4605 | GAAATCCCTTCAGGAT | 86 | 2302 |
| 1157850 | 4599 | 4614 | 4798 | 4813 | CAAGCTGAACTATCAC | 73 | 2303 |
| 1157883 | 4719 | 4734 | 4918 | 4933 | TCTAGGCCATCATACT | 60 | 2304 |
| 1157916 | 4805 | 4820 | 5004 | 5019 | GGTTATGCTTATTCCC | 63 | 2305 |

TABLE 60-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157950 | 4894 | 4909 | 5093 | 5108 | GATTCCGTAACTTTAA | 31 | 2306 |
| 1157984 | 4984 | 4999 | 5183 | 5198 | TTGAGATGGACATTGC | 13 | 2307 |
| 1158017 | 5106 | 5121 | 5305 | 5320 | TCCTCAATCCACTTGA | 56 | 2308 |
| 1158050 | 5173 | 5188 | 5372 | 5387 | AGCAACTCTTCTGATA | 70 | 2309 |
| 1158083 | 5261 | 5276 | 5460 | 5475 | CACTTATCCCTAACAT | 90 | 2310 |
| 1158115 | 5368 | 5383 | 5567 | 5582 | AAAAAGGCTCGATGGA | 48 | 2311 |
| 1158148 | 5475 | 5490 | 5674 | 5689 | ACTGATCACTTTAGAG | 64 | 2312 |
| 1158182 | 5560 | 5575 | 5759 | 5774 | GATTCTAACAGCACAT | 69 | 2313 |
| 1158215 | 5744 | 5759 | 5943 | 5958 | TAGAGAAGAATCCCCC | 66 | 2314 |
| 1158248 | 5863 | 5878 | 6062 | 6077 | GCTCATCACTTTATGA | 90 | 2315 |
| 1158281 | 5949 | 5964 | 6148 | 6163 | TCTGATCATAATCTCC | 61 | 2316 |
| 1158315 | 6072 | 6087 | 6271 | 6286 | CTAAGATTGTAAGCAT | 72 | 2317 |
| 1158349 | 6117 | 6132 | 6316 | 6331 | CCCTTCCCTATATAAG | 95 | 2318 |
| 1158382 | 6267 | 6282 | 6466 | 6481 | TGCTGATAAACTCACT | 54 | 2319 |
| 1158415 | 6422 | 6437 | 6621 | 6636 | GAACAGTACTGCATTT | 72 | 2320 |
| 1158447 | 6505 | 6520 | 6704 | 6719 | AATCACTACTCCAAGC | 71 | 2321 |
| 1158481 | 6609 | 6624 | 6808 | 6823 | CCAGCAAAATGTACTC | 54 | 2322 |
| 1158512 | 6851 | 6866 | 7050 | 7065 | AGTGTTCCTGCATGTA | 69 | 2323 |
| 1158544 | 7020 | 7035 | 7219 | 7234 | GTGAATTCAACTGGAA | 50 | 2324 |
| 1158578 | 7135 | 7150 | 7334 | 7349 | AGTTACTCCAGCATAA | 69 | 2325 |
| 1158610 | 7264 | 7279 | 7463 | 7478 | AAGGCTCCATGGTTGT | 68 | 2326 |
| 1158644 | 7389 | 7404 | 7588 | 7603 | CTTCGGATGCTTCACT | 67 | 2327 |
| 1158677 | 7490 | 7505 | 7689 | 7704 | CCCTTCAAGCACCGCT | 72 | 2328 |
| 11587111 | 7616 | 7631 | 7815 | 7830 | TCTGTGCTAGATCAAA | 39 | 2329 |
| 1158745 | 7687 | 7702 | 7886 | 7901 | CTTGAAACCGATTATG | 62 | 2330 |
| 1158778 | 7752 | 7767 | 7951 | 7966 | GCAGGCAAATTAATGG | 55 | 2331 |
| 1158811 | 7831 | 7846 | 8030 | 8045 | TAAGTTGGTTTTAGTC | 22 | 2332 |
| 1158844 | 7924 | 7939 | 8123 | 8138 | GCCACTCAAATGCCTA | 82 | 2333 |
| 1158877 | 8030 | 8045 | 8229 | 8244 | ATTGGAGATCAGCTTC | 48 | 2334 |
| 1158909 | 8186 | 8201 | 8385 | 8400 | ATTTGAACCCCGTCCT | 69 | 2335 |
| 1158942 | 8310 | 8325 | 8509 | 8524 | AAAGATATTGTGCTGT | 89 | 2336 |
| 1158976 | 8396 | 8411 | 8595 | 8610 | GCAGTTATATTAGGTT | 85 | 2337 |
| 1159009 | 997 | 1012 | N/A | N/A | GCCGCCTCTTAAAGCA | 111 | 2338 |

TABLE 61

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 82 | 18 |
| 556094 | 6674 | 6689 | 6873 | 6888 | GACTAAAGGCTTCAGT | 85 | 2339 |
| 559497 | 3629 | 3644 | 3829 | 3844 | AGTACTATAGCATCTG | 108 | 32 |
| 559564 | 2839 | 2854 | 3039 | 3054 | CCATAAGTAAGTTCCA | 39 | 36 |
| 568456 | 3118 | 3133 | 3318 | 3333 | CAAACTGCTTACAGAT | 69 | 2340 |
| 1156478 | 120 | 135 | 86 | 101 | CAGGCGAGCTGAGGCT | 93 | 2341 |
| 1156511 | 243 | 258 | 209 | 224 | TAAATACCACCACCTG | 98 | 2342 |
| 1156545 | 344 | 359 | 310 | 325 | GTTAGGTATGAGCTTC | 85 | 2343 |
| 1156579 | 478 | 493 | 444 | 459 | ACTAAGCGAATGGCTT | 109 | 2344 |
| 1156613 | 525 | 540 | 491 | 506 | CAAATCGCCATGGAAA | 86 | 2345 |
| 1156647 | 593 | 608 | 559 | 574 | CCACGGCCCGCACGGA | 94 | 2346 |
| 1156681 | 711 | 726 | 677 | 692 | CCACTCTTGGAAAACG | 77 | 2347 |
| 1156714 | 818 | 833 | 784 | 799 | TGCAGTCCTGCGACTT | 85 | 2348 |
| 1156748 | 875 | 890 | 841 | 856 | AGCCTTGCAGGGACGG | 121 | 2349 |
| 1156782 | 952 | 967 | 918 | 933 | TATAGTTTACCACCTT | 86 | 2350 |
| 1156816 | N/A | N/A | 989 | 1004 | CCTCACAAAACCCCCG | 113 | 2351 |
| 1156850 | N/A | N/A | 1115 | 1130 | CTTATGGAACTTGAAT | 105 | 2352 |
| 1156884 | 1011 | 1026 | 1211 | 1226 | TTCGATCACCTTCCGC | 88 | 2353 |
| 1156918 | 1062 | 1077 | 1262 | 1277 | CAGCTCGGGCGAGGCG | 87 | 2354 |
| 1156952 | 1141 | 1156 | 1341 | 1356 | AACTTATCTGCGGTTT | 94 | 2355 |
| 1156986 | 1293 | 1308 | 1493 | 1508 | CCTCATGCTACTCTTC | 46 | 2356 |
| 1157019 | 1492 | 1507 | 1692 | 1707 | AATCACCTACAACTTT | 74 | 2357 |
| 1157053 | 1583 | 1598 | 1783 | 1798 | ATGACGCAATTCTCCC | 85 | 2358 |
| 1157086 | 1727 | 1742 | 1927 | 1942 | TATTCTTTTCTTCGCC | 51 | 2359 |
| 1157120 | 2080 | 2095 | 2280 | 2295 | CTTCTGCACCACCAGA | 87 | 2360 |
| 1157154 | 2273 | 2288 | 2473 | 2488 | TATATTTAAGGCCTTC | 55 | 2361 |
| 1157187 | 2337 | 2352 | 2537 | 2552 | AATTACTCTTGATCTT | 49 | 2362 |
| 1157220 | 2424 | 2439 | 2624 | 2639 | ACCTGGGTCAGCTGTC | 86 | 2363 |
| 1157254 | 2539 | 2554 | 2739 | 2754 | ACCACGAACTGCTGCT | 48 | 2364 |
| 1157288 | 2666 | 2681 | 2866 | 2881 | CCAAATTGCACTCGCT | 64 | 2365 |
| 1157321 | 2739 | 2754 | 2939 | 2954 | GGATCCTCTACGCACA | 81 | 2366 |
| 1157355 | 2808 | 2823 | 3008 | 3023 | GCCGACCTCACGGATT | 55 | 2367 |
| 1157389 | 2886 | 2901 | 3086 | 3101 | CTCAGTACGAAACTCC | 70 | 2368 |
| 1157422 | 2963 | 2978 | 3163 | 3178 | CATGAGTATAAGCCTG | 50 | 2369 |
| 1157488 | 3226 | 3241 | 3426 | 3441 | CAGTTACACATCCAAA | 55 | 2370 |
| 1157521 | 3321 | 3336 | 3521 | 3536 | CTTTAGGATTCTAGAC | 93 | 2371 |
| 1157555 | 3420 | 3435 | 3620 | 3635 | GTGAGAACTGCTCTAG | 64 | 2372 |

TABLE 61-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157587 | 3624 | 3639 | 3824 | 3839 | TATAGCATCTGTGGAA | 80 | 2373 |
| 1157620 | 3676 | 3691 | 3876 | 3891 | TGCCAACAGCACAGCG | 99 | 2374 |
| 1157654 | 3818 | 3833 | 4018 | 4033 | AACATTTGGCCTACTC | 58 | 2375 |
| 1157687 | 3937 | 3952 | 4137 | 4152 | TACCTAAACCCACCCC | 94 | 2376 |
| 1157721 | 4046 | 4061 | 4246 | 4261 | ATCATTGGGAGTTACT | 46 | 2377 |
| 1157754 | 4144 | 4159 | 4344 | 4359 | TGACACTTTCCTTGCC | 34 | 2378 |
| 1157787 | 4255 | 4270 | 4455 | 4470 | CCCATAATTGTAGTTA | 55 | 2379 |
| 1157821 | 4410 | 4425 | 4610 | 4625 | TACAAAAGCTACCATC | 88 | 2380 |
| 1157854 | 4605 | 4620 | 4804 | 4819 | GACATTCAAGCTGAAC | 47 | 2381 |
| 1157887 | 4726 | 4741 | 4925 | 4940 | CTCTGCATCTAGGCCA | 60 | 2382 |
| 1157920 | 4809 | 4824 | 5008 | 5023 | TCAGGGTTATGCTTAT | 36 | 2383 |
| 1157954 | 4898 | 4913 | 5097 | 5112 | GGTAGATTCCGTAACT | 40 | 2384 |
| 1157988 | 5045 | 5060 | 5244 | 5259 | TAATGTAGTGTAACAT | 71 | 2385 |
| 1158021 | 5132 | 5147 | 5331 | 5346 | ACGAAACATTGGCACA | 38 | 2386 |
| 1158054 | 5216 | 5231 | 5415 | 5430 | CTGTTAACAGCTGCCT | 48 | 2387 |
| 1158087 | 5266 | 5281 | 5465 | 5480 | ATAAGCACTTATCCCT | 50 | 2388 |
| 1158119 | 5372 | 5387 | 5571 | 5586 | TTTTAAAAGGCTCGA | 88 | 2389 |
| 1158152 | 5482 | 5497 | 5681 | 5696 | TCAAGGCACTGATCAC | 51 | 2390 |
| 1158186 | 5571 | 5586 | 5770 | 5785 | CAGTAACATCTGATTC | 43 | 2391 |
| 1158219 | 5768 | 5783 | 5967 | 5982 | TCGCAGACAAAGTTTC | 69 | 2392 |
| 1158252 | 5882 | 5897 | 6081 | 6096 | GTGCCTGGAATTATTA | 61 | 2393 |
| 1158285 | 5957 | 5972 | 6156 | 6171 | CCTTTTACTCTGATCA | 44 | 2394 |
| 1158319 | 6076 | 6091 | 6275 | 6290 | CACTCTAAGATTGTAA | 67 | 2395 |
| 1158353 | 6173 | 6188 | 6372 | 6387 | GAAGGATGAAATGCCT | 93 | 2396 |
| 1158386 | 6274 | 6289 | 6473 | 6488 | TTGAGTATGCTGATAA | 39 | 2397 |
| 1158419 | 6432 | 6447 | 6631 | 6646 | AGCGGGATCAGAACAG | 57 | 2398 |
| 1158451 | 6510 | 6525 | 6709 | 6724 | TCAACAATCACTACTC | 84 | 2399 |
| 1158516 | 6898 | 6913 | 7097 | 7112 | CTTACTGGGTCTGGCT | 59 | 2400 |
| 1158548 | 7033 | 7048 | 7232 | 7247 | ATTTTGTCCACTGGTG | 50 | 2401 |
| 1158582 | 7145 | 7160 | 7344 | 7359 | CTCACATGCCAGTTAC | 49 | 2402 |
| 1158614 | 7289 | 7304 | 7488 | 7503 | GCTTTGTTGTCTCTCC | 7 | 2403 |
| 1158648 | 7394 | 7409 | 7593 | 7608 | CATTCCTTCGGATGCT | 62 | 2404 |
| 1158681 | 7512 | 7527 | 7711 | 7726 | GCCGCTTTCCCCCTT | 129 | 2405 |
| 1158715 | 7648 | 7663 | 7847 | 7862 | CTACTGGCTGCATCGA | 46 | 2406 |
| 1158749 | 7691 | 7706 | 7890 | 7905 | TTACCTTGAAACCGAT | 69 | 2407 |
| 1158781 | 7763 | 7778 | 7962 | 7977 | GTTAACAATTTGCAGG | 60 | 2408 |

TABLE 61-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158815 | 7840 | 7855 | 8039 | 8054 | TTACTGGTTTAAGTTG | 76 | 2409 |
| 1158848 | 7940 | 7955 | 8139 | 8154 | CCCAAAAGCCCTCTCA | 88 | 2410 |
| 1158881 | 8035 | 8050 | 8234 | 8249 | AGAGCATTGGAGATCA | 80 | 2411 |
| 1158913 | 8190 | 8205 | 8389 | 8404 | AGGGATTTGAACCCCG | 103 | 2412 |
| 1158946 | 8324 | 8339 | 8523 | 8538 | GATGTATATAGTTCAA | 93 | 2413 |
| 1158980 | 8419 | 8434 | 8618 | 8633 | GGCTATTACCTGAAAA | 94 | 2414 |
| 1159013 | 1002 | 1017 | N/A | N/A | CTTCCGCCGCCTCTTA | 91 | 2415 |

TABLE 62

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 87 | 18 |
| 559497 | 3629 | 3644 | 3829 | 3844 | AGTACTATAGCATCTG | 123 | 32 |
| 559564 | 2839 | 2854 | 3039 | 3054 | CCATAAGTAAGTTCCA | 45 | 36 |
| 946419 | 6899 | 6914 | 7098 | 7113 | TCTTACTGGGTCTGGC | 55 | 2416 |
| 1156479 | 121 | 136 | 87 | 102 | TCAGGCGAGCTGAGGC | 93 | 2417 |
| 1156512 | 244 | 259 | 210 | 225 | CTAAATACCACCACCT | 88 | 2418 |
| 1156546 | 345 | 360 | 311 | 326 | GGTTAGGTATGAGCTT | 92 | 2419 |
| 1156580 | 480 | 495 | 446 | 461 | CAACTAAGCGAATGGC | 76 | 2420 |
| 1156614 | 526 | 541 | 492 | 507 | GCAAATCGCCATGGAA | 79 | 2421 |
| 1156648 | 594 | 609 | 560 | 575 | CCCACGGCCCGCACGG | 86 | 2422 |
| 1156682 | 717 | 732 | 683 | 698 | GAAAACCCACTCTTGG | 90 | 2423 |
| 1156715 | 825 | 840 | 791 | 806 | AACTGCTTGCAGTCCT | 95 | 2424 |
| 1156749 | 889 | 904 | 855 | 870 | CGCAACTGAGCCCCAG | 82 | 2425 |
| 1156783 | 953 | 968 | 919 | 934 | GTATAGTTTACCACCT | 91 | 2426 |
| 1156817 | N/A | N/A | 999 | 1014 | TCATCAAACACCTCAC | 108 | 2427 |
| 1156851 | N/A | N/A | 1116 | 1131 | GCTTATGGAACTTGAA | 90 | 2428 |
| 1156885 | 1012 | 1027 | 1212 | 1227 | ATTCGATCACCTTCCG | 81 | 2429 |
| 1156919 | 1064 | 1079 | 1264 | 1279 | CACAGCTCGGGCGAGG | 75 | 2430 |
| 1156953 | 1142 | 1157 | 1342 | 1357 | AAACTTATCTGCGGTT | 81 | 2431 |
| 1156987 | 1327 | 1342 | 1527 | 1542 | CCGTCATGTTTTAGAA | 42 | 2432 |
| 1157020 | 1510 | 1525 | 1710 | 1725 | TCGCCTTCAAATTATT | 65 | 2433 |
| 1157054 | 1584 | 1599 | 1784 | 1799 | AATGACGCAATTCTCC | 79 | 2434 |
| 1157087 | 1728 | 1743 | 1928 | 1943 | CTATTCTTTTCTTCGC | 63 | 2435 |
| 1157121 | 2084 | 2099 | 2284 | 2299 | CTAACTTCTGCACCAC | 62 | 2436 |

TABLE 62-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157155 | 2274 | 2289 | 2474 | 2489 | CTATATTTAAGGCCTT | 74 | 2437 |
| 1157188 | 2338 | 2353 | 2538 | 2553 | TAATTACTCTTGATCT | 52 | 2438 |
| 1157221 | 2425 | 2440 | 2625 | 2640 | CACCTGGGTCAGCTGT | 75 | 2439 |
| 1157255 | 2540 | 2555 | 2740 | 2755 | CACCACGAACTGCTGC | 81 | 2440 |
| 1157289 | 2667 | 2682 | 2867 | 2882 | ACCAAATTGCACTCGC | 60 | 2441 |
| 1157322 | 2741 | 2756 | 2941 | 2956 | TAGGATCCTCTACGCA | 77 | 2442 |
| 1157356 | 2809 | 2824 | 3009 | 3024 | TGCCGACCTCACGGAT | 76 | 2443 |
| 1157390 | 2887 | 2902 | 3087 | 3102 | CCTCAGTACGAAACTC | 84 | 2444 |
| 1157423 | 2966 | 2981 | 3166 | 3181 | ATTCATGAGTATAAGC | 71 | 2445 |
| 1157455 | 3119 | 3134 | 3319 | 3334 | ACAAACTGCTTACAGA | 83 | 2446 |
| 1157489 | 3228 | 3243 | 3428 | 3443 | CTCAGTTACACATCCA | 30 | 2447 |
| 1157522 | 3323 | 3338 | 3523 | 3538 | GCCTTTAGGATTCTAG | 70 | 2448 |
| 1157556 | 3421 | 3436 | 3621 | 3636 | CGTGAGAACTGCTCTA | 63 | 2449 |
| 1157588 | 3625 | 3640 | 3825 | 3840 | CTATAGCATCTGTGGA | 71 | 2450 |
| 1157621 | 3692 | 3707 | 3892 | 3907 | TCCCTGAAGGTGTTCG | 82 | 2451 |
| 1157655 | 3819 | 3834 | 4019 | 4034 | CAACATTTGGCCTACT | 83 | 2452 |
| 1157688 | 3938 | 3953 | 4138 | 4153 | TTACCTAAACCCACCC | 62 | 2453 |
| 1157722 | 4047 | 4062 | 4247 | 4262 | AATCATTGGGAGTTAC | 76 | 2454 |
| 1157755 | 4146 | 4161 | 4346 | 4361 | TATGACACTTTCCTTG | 75 | 2455 |
| 1157788 | 4256 | 4271 | 4456 | 4471 | TCCCATAATTGTAGTT | 73 | 2456 |
| 1157822 | 4422 | 4437 | 4622 | 4637 | CTTACTTGATAATACA | 65 | 2457 |
| 1157855 | 4610 | 4625 | 4809 | 4824 | TAAGAGACATTCAAGC | 83 | 2458 |
| 1157888 | 4744 | 4759 | 4943 | 4958 | TCACCAAGGAGCTGTT | 88 | 2459 |
| 1157921 | 4810 | 4825 | 5009 | 5024 | CTCAGGGTTATGCTTA | 60 | 2460 |
| 1157955 | 4900 | 4915 | 5099 | 5114 | ATGGTAGATTCCGTAA | 86 | 2461 |
| 1157989 | 5046 | 5061 | 5245 | 5260 | TTAATGTAGTGTAACA | 70 | 2462 |
| 1158022 | 5133 | 5148 | 5332 | 5347 | AACGAAACATTGGCAC | 52 | 2463 |
| 1158055 | 5217 | 5232 | 5416 | 5431 | TCTGTTAACAGCTGCC | 49 | 2464 |
| 1158088 | 5267 | 5282 | 5466 | 5481 | AATAAGCACTTATCCC | 69 | 2465 |
| 1158120 | 5373 | 5388 | 5572 | 5587 | ATTTTAAAAGGCTCG | 73 | 2466 |
| 1158153 | 5483 | 5498 | 5682 | 5697 | ATCAAGGCACTGATCA | 77 | 2467 |
| 1158187 | 5572 | 5587 | 5771 | 5786 | GCAGTAACATCTGATT | 43 | 2468 |
| 1158220 | 5769 | 5784 | 5968 | 5983 | TTCGCAGACAAAGTTT | 78 | 2469 |
| 1158253 | 5885 | 5900 | 6084 | 6099 | CATGTGCCTGGAATTA | 74 | 2470 |
| 1158286 | 5958 | 5973 | 6157 | 6172 | ACCTTTTACTCTGATC | 66 | 2471 |
| 1158320 | 6077 | 6092 | 6276 | 6291 | CCACTCTAAGATTGTA | 60 | 2472 |

TABLE 62-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158354 | 6174 | 6189 | 6373 | 6388 | TGAAGGATGAAATGCC | 71 | 2473 |
| 1158387 | 6275 | 6290 | 6474 | 6489 | TTTGAGTATGCTGATA | 53 | 2474 |
| 1158420 | 6433 | 6448 | 6632 | 6647 | CAGCGGGATCAGAACA | 77 | 2475 |
| 1158452 | 6512 | 6527 | 6711 | 6726 | CTTCAACAATCACTAC | 98 | 2476 |
| 1158485 | 6675 | 6690 | 6874 | 6889 | AGACTAAAGGCTTCAG | 88 | 2477 |
| 1158549 | 7055 | 7070 | 7254 | 7269 | AGCTTGTTCACCTGTT | 63 | 2478 |
| 1158583 | 7146 | 7161 | 7345 | 7360 | GCTCACATGCCAGTTA | 68 | 2479 |
| 1158615 | 7290 | 7305 | 7489 | 7504 | CGCTTTGTTGTCTCTC | 13 | 2480 |
| 1158649 | 7396 | 7411 | 7595 | 7610 | AGCATTCCTTCGGATG | 86 | 2481 |
| 1158682 | 7514 | 7529 | 7713 | 7728 | TTGCCCGCTTTCCCCC | 81 | 2482 |
| 1158716 | 7649 | 7664 | 7848 | 7863 | GCTACTGGCTGCATCG | 57 | 2483 |
| 1158750 | 7692 | 7707 | 7891 | 7906 | GTTACCTTGAAACCGA | 53 | 2484 |
| 1158782 | 7764 | 7779 | 7963 | 7978 | TGTTAACAATTTGCAG | 80 | 2485 |
| 1158816 | 7842 | 7857 | 8041 | 8056 | ACTTACTGGTTTAAGT | 103 | 2486 |
| 1158849 | 7941 | 7956 | 8140 | 8155 | ACCCAAAAGCCCTCTC | 87 | 2487 |
| 1158882 | 8036 | 8051 | 8235 | 8250 | AAGAGCATTGGAGATC | 67 | 2488 |
| 1158914 | 8193 | 8208 | 8392 | 8407 | CGCAGGGATTTGAACC | 85 | 2489 |
| 1158947 | 8325 | 8340 | 8524 | 8539 | GGATGTATATAGTTCA | 70 | 2490 |
| 1158981 | 8420 | 8435 | 8619 | 8634 | AGGCTATTACCTGAAA | 105 | 2491 |
| 1159014 | 1003 | 1018 | N/A | N/A | CCTTCCGCCGCCTCTT | 97 | 2492 |

TABLE 63

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 80 | 18 |
| 559497 | 3629 | 3644 | 3829 | 3844 | AGTACTATAGCATCTG | 112 | 32 |
| 559564 | 2839 | 2854 | 3039 | 3054 | CCATAAGTAAGTTCCA | 40 | 36 |
| 568447 | 2339 | 2354 | 2539 | 2554 | GTAATTACTCTTGATC | 53 | 2493 |
| 1156480 | 123 | 138 | 89 | 104 | CTTCAGGCGAGCTGAG | 104 | 2494 |
| 1156513 | 248 | 263 | 214 | 229 | TTATCTAAATACCACC | 98 | 2495 |
| 1156547 | 346 | 361 | 312 | 327 | TGGTTAGGTATGAGCT | 96 | 2496 |
| 1156581 | 481 | 496 | 447 | 462 | CCAACTAAGCGAATGG | 82 | 2497 |
| 1156615 | 527 | 542 | 493 | 508 | GGCAAATCGCCATGGA | 78 | 2498 |
| 1156649 | 595 | 610 | 561 | 576 | CCCCACGGCCCGCACG | 109 | 2499 |
| 1156683 | 718 | 733 | 684 | 699 | TGAAAACCCACTCTTG | 100 | 2500 |

TABLE 63-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1156716 | 827 | 842 | 793 | 808 | CCAACTGCTTGCAGTC | 75 | 2501 |
| 1156750 | 890 | 905 | 856 | 871 | ACGCAACTGAGCCCCA | 144 | 2502 |
| 1156784 | 955 | 970 | 921 | 936 | AGGTATAGTTTACCAC | 107 | 2503 |
| 1156818 | N/A | N/A | 1004 | 1019 | ACGGGTCATCAAACAC | 86 | 2504 |
| 1156852 | N/A | N/A | 1117 | 1132 | AGCTTATGGAACTTGA | 84 | 2505 |
| 1156886 | 1013 | 1028 | 1213 | 1228 | AATTCGATCACCTTCC | 84 | 2506 |
| 1156920 | 1065 | 1080 | 1265 | 1280 | GCACAGCTCGGGCGAG | 120 | 2507 |
| 1156954 | 1143 | 1158 | 1343 | 1358 | AAAACTTATCTGCGGT | 46 | 2508 |
| 1156988 | 1328 | 1343 | 1528 | 1543 | TCCGTCATGTTTTAGA | 50 | 2509 |
| 1157021 | 1511 | 1526 | 1711 | 1726 | ATCGCCTTCAAATTAT | 40 | 2510 |
| 1157055 | 1586 | 1601 | 1786 | 1801 | TAAATGACGCAATTCT | 92 | 2511 |
| 1157088 | 1805 | 1820 | 2005 | 2020 | GCTTCCTACTTTTCAG | 56 | 2512 |
| 1157122 | 2086 | 2101 | 2286 | 2301 | TTCTAACTTCTGCACC | 67 | 2513 |
| 1157156 | 2275 | 2290 | 2475 | 2490 | ACTATATTTAAGGCCT | 60 | 2514 |
| 1157222 | 2427 | 2442 | 2627 | 2642 | AGCACCTGGGTCAGCT | 105 | 2515 |
| 1157256 | 2543 | 2558 | 2743 | 2758 | CTTCACCACGAACTGC | 57 | 2516 |
| 1157290 | 2668 | 2683 | 2868 | 2883 | CACCAAATTGCACTCG | 46 | 2517 |
| 1157323 | 2742 | 2757 | 2942 | 2957 | CTAGGATCCTCTACGC | 89 | 2518 |
| 1157357 | 2810 | 2825 | 3010 | 3025 | TTGCCGACCTCACGGA | N.D. | 2519 |
| 1157391 | 2891 | 2906 | 3091 | 3106 | TACACCTCAGTACGAA | 72 | 2520 |
| 1157424 | 2967 | 2982 | 3167 | 3182 | GATTCATGAGTATAAG | 50 | 2521 |
| 1157456 | 3120 | 3135 | 3320 | 3335 | TACAAACTGCTTACAG | 61 | 2522 |
| 1157490 | 3229 | 3244 | 3429 | 3444 | CCTCAGTTACACATCC | 51 | 2523 |
| 1157523 | 3324 | 3339 | 3524 | 3539 | TGCCTTTAGGATTCTA | 55 | 2524 |
| 1157557 | 3436 | 3451 | 3636 | 3651 | TTCCACAGACCTCAAC | 104 | 2525 |
| 1157589 | 3626 | 3641 | 3826 | 3841 | ACTATAGCATCTGTGG | 91 | 2526 |
| 1157622 | 3693 | 3708 | 3893 | 3908 | GTCCCTGAAGGTGTTC | 77 | 2527 |
| 1157656 | 3820 | 3835 | 4020 | 4035 | TCAACATTTGGCCTAC | 79 | 2528 |
| 1157689 | 3939 | 3954 | 4139 | 4154 | ATTACCTAAACCCACC | 110 | 2529 |
| 1157723 | 4048 | 4063 | 4248 | 4263 | AAATCATTGGGAGTTA | 76 | 2530 |
| 1157756 | 4156 | 4171 | 4356 | 4371 | AGTATCAAATTATGAC | N.D. | 2531 |
| 1157789 | 4257 | 4272 | 4457 | 4472 | TTCCCATAATTGTAGT | 82 | 2532 |
| 1157823 | 4423 | 4438 | 4623 | 4638 | TCTTACTTGATAATAC | 90 | 2533 |
| 1157856 | 4611 | 4626 | 4810 | 4825 | CTAAGAGACATTCAAG | 73 | 2534 |
| 1157889 | 4745 | 4760 | 4944 | 4959 | TTCACCAAGGAGCTGT | 63 | 2535 |
| 1157922 | 4811 | 4826 | 5010 | 5025 | TCTCAGGGTTATGCTT | 41 | 2536 |

TABLE 63-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157956 | 4901 | 4916 | 5100 | 5115 | AATGGTAGATTCCGTA | 53 | 2537 |
| 1157990 | 5048 | 5063 | 5247 | 5262 | GATTAATGTAGTGTAA | 77 | 2538 |
| 1158023 | 5134 | 5149 | 5333 | 5348 | AAACGAAACATTGGCA | 54 | 2539 |
| 1158056 | 5218 | 5233 | 5417 | 5432 | ATCTGTTAACAGCTGC | 29 | 2540 |
| 1158089 | 5268 | 5283 | 5467 | 5482 | AAATAAGCACTTATCC | 82 | 2541 |
| 1158121 | 5385 | 5400 | 5584 | 5599 | ACAAGTCCTACAATTT | 69 | 2542 |
| 1158154 | 5484 | 5499 | 5683 | 5698 | CATCAAGGCACTGATC | 87 | 2543 |
| 1158188 | 5573 | 5588 | 5772 | 5787 | AGCAGTAACATCTGAT | 59 | 2544 |
| 1158221 | 5770 | 5785 | 5969 | 5984 | GTTCGCAGACAAAGTT | 64 | 2545 |
| 1158254 | 5893 | 5908 | 6092 | 6107 | TCTATTGCCATGTGCC | 59 | 2546 |
| 1158287 | 5959 | 5974 | 6158 | 6173 | TACCTTTTACTCTGAT | 58 | 2547 |
| 1158321 | 6078 | 6093 | 6277 | 6292 | ACCACTCTAAGATTGT | 111 | 2548 |
| 1158355 | 6190 | 6205 | 6389 | 6404 | ATCCTGAATGGCTTCA | 100 | 2549 |
| 1158388 | 6278 | 6293 | 6477 | 6492 | AATTTGAGTATGCTG | 46 | 2550 |
| 1158421 | 6434 | 6449 | 6633 | 6648 | GCAGCGGGATCAGAAC | 66 | 2551 |
| 1158453 | 6534 | 6549 | 6733 | 6748 | TATCACTCAGCTGGAT | 66 | 2552 |
| 1158486 | 6676 | 6691 | 6875 | 6890 | AAGACTAAAGGCTTCA | 79 | 2553 |
| 1158517 | 6920 | 6935 | 7119 | 7134 | TAAAGTAAATAGGCTA | 79 | 2554 |
| 1158550 | 7058 | 7073 | 7257 | 7272 | AAAAGCTTGTTCACCT | 79 | 2555 |
| 1158584 | 7148 | 7163 | 7347 | 7362 | TTGCTCACATGCCAGT | 60 | 2556 |
| 1158616 | 7304 | 7319 | 7503 | 7518 | CCTTAGGATAATAGCG | 40 | 2557 |
| 1158650 | 7397 | 7412 | 7596 | 7611 | AAGCATTCCTTCGGAT | 108 | 2558 |
| 1158683 | 7520 | 7535 | 7719 | 7734 | AAGTGGTTGCCCGCTT | 78 | 2559 |
| 1158717 | 7650 | 7665 | 7849 | 7864 | AGCTACTGGCTGCATC | N.D. | 2560 |
| 1158751 | 7693 | 7708 | 7892 | 7907 | CGTTACCTTGAAACCG | 64 | 2561 |
| 1158783 | 7773 | 7788 | 7972 | 7987 | ATACCCTTCTGTTAAC | 98 | 2562 |
| 1158817 | 7844 | 7859 | 8043 | 8058 | CCACTTACTGGTTTAA | 67 | 2563 |
| 1158850 | 7942 | 7957 | 8141 | 8156 | CACCCAAAAGCCCTCT | 83 | 2564 |
| 1158883 | 8037 | 8052 | 8236 | 8251 | GAAGAGCATTGGAGAT | 51 | 2565 |
| 1158915 | 8194 | 8209 | 8393 | 8408 | CCGCAGGGATTTGAAC | 98 | 2566 |
| 1158948 | 8326 | 8341 | 8525 | 8540 | AGGATGTATATAGTTC | 98 | 2567 |
| 1158982 | 8421 | 8436 | 8620 | 8635 | CAGGCTATTACCTGAA | 114 | 2568 |
| 1159015 | 1004 | 1019 | N/A | N/A | ACCTTCCGCCGCCTCT | 67 | 2569 |

TABLE 64

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395254 | 4843 | 4862 | 5042 | 5061 | GGCATATGCAGATAATGTTC | 97 | 18 |
| 559497 | 3629 | 3644 | 3829 | 3844 | AGTACTATAGCATCTG | 141 | 32 |
| 559564 | 2839 | 2854 | 3039 | 3054 | CCATAAGTAAGTTCCA | 52 | 36 |
| 567926 | 4746 | 4761 | 4945 | 4960 | ATTCACCAAGGAGCTG | 61 | 2570 |
| 568506 | 8195 | 8210 | 8394 | 8409 | GCCGCAGGGATTTGAA | 69 | 2571 |
| 1156481 | 130 | 145 | 96 | 111 | GACCTGCCTTCAGGCG | N.D. | 2572 |
| 1156514 | 251 | 266 | 217 | 232 | GTTTTATCTAAATACC | 71 | 2573 |
| 1156548 | 347 | 362 | 313 | 328 | CTGGTTAGGTATGAGC | 97 | 2574 |
| 1156582 | 482 | 497 | 448 | 463 | ACCAACTAAGCGAATG | 112 | 2575 |
| 1156616 | 528 | 543 | 494 | 509 | AGGCAAATCGCCATGG | 95 | 2576 |
| 1156650 | 597 | 612 | 563 | 578 | CCCCCCACGGCCCGCA | 74 | 2577 |
| 1156684 | 719 | 734 | 685 | 700 | GTGAAAACCCACTCTT | 90 | 2578 |
| 1156717 | 828 | 843 | 794 | 809 | CCCAACTGCTTGCAGT | 91 | 2579 |
| 1156751 | 891 | 906 | 857 | 872 | TACGCAACTGAGCCCC | 100 | 2580 |
| 1156785 | 956 | 971 | 922 | 937 | TAGGTATAGTTTACCA | 98 | 2581 |
| 1156819 | N/A | N/A | 1005 | 1020 | AACGGGTCATCAAACA | 125 | 2582 |
| 1156853 | N/A | N/A | 1118 | 1133 | CAGCTTATGGAACTTG | 133 | 2583 |
| 1156887 | 1014 | 1029 | 1214 | 1229 | GAATTCGATCACCTTC | 101 | 2584 |
| 1156921 | 1067 | 1082 | 1267 | 1282 | CCGCACAGCTCGGGCG | 86 | 2585 |
| 1156955 | 1144 | 1159 | 1344 | 1359 | AAAAACTTATCTGCGG | 51 | 2586 |
| 1156989 | 1329 | 1344 | 1529 | 1544 | CTCCGTCATGTTTTAG | 33 | 2587 |
| 1157022 | 1512 | 1527 | 1712 | 1727 | GATCGCCTTCAAATTA | 61 | 2588 |
| 1157056 | 1587 | 1602 | 1787 | 1802 | TTAAATGACGCAATTC | 96 | 2589 |
| 1157089 | 1831 | 1846 | 2031 | 2046 | GTTTCCTAGCTTGTCT | 43 | 2590 |
| 1157123 | 2089 | 2104 | 2289 | 2304 | ACCTTCTAACTTCTGC | 36 | 2591 |
| 1157157 | 2276 | 2291 | 2476 | 2491 | TACTATATTTAAGGCC | 99 | 2592 |
| 1157189 | 2340 | 2355 | 2540 | 2555 | GGTAATTACTCTTGAT | 50 | 2593 |
| 1157223 | 2431 | 2446 | 2631 | 2646 | GTGTAGCACCTGGGTC | 36 | 2594 |
| 1157257 | 2545 | 2560 | 2745 | 2760 | ATCTTCACCACGAACT | 78 | 2595 |
| 1157291 | 2669 | 2684 | 2869 | 2884 | TCACCAAATTGCACTC | 79 | 2596 |
| 1157324 | 2743 | 2758 | 2943 | 2958 | TCTAGGATCCTCTACG | 124 | 2597 |
| 1157358 | 2813 | 2828 | 3013 | 3028 | ATATTGCCGACCTCAC | 74 | 2598 |
| 1157392 | 2892 | 2907 | 3092 | 3107 | TTACACCTCAGTACGA | 85 | 2599 |
| 1157425 | 2970 | 2985 | 3170 | 3185 | CAAGATTCATGAGTAT | 66 | 2600 |
| 1157457 | 3121 | 3136 | 3321 | 3336 | ATACAAACTGCTTACA | 130 | 2601 |
| 1157491 | 3233 | 3248 | 3433 | 3448 | CCCGCCTCAGTTACAC | 96 | 2602 |
| 1157524 | 3332 | 3347 | 3532 | 3547 | GAGTCATTTGCCTTTA | 27 | 2603 |

TABLE 64-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1157558 | 3445 | 3460 | 3645 | 3660 | GGACATCTCTTCCACA | 76 | 2604 |
| 1157590 | 3627 | 3642 | 3827 | 3842 | TACTATAGCATCTGTG | 107 | 2605 |
| 1157623 | 3694 | 3709 | 3894 | 3909 | AGTCCCTGAAGGTGTT | 72 | 2606 |
| 1157657 | 3822 | 3837 | 4022 | 4037 | CTTCAACATTTGGCCT | 82 | 2607 |
| 1157690 | 3940 | 3955 | 4140 | 4155 | AATTACCTAAACCCAC | 100 | 2608 |
| 1157724 | 4049 | 4064 | 4249 | 4264 | TAAATCATTGGGAGTT | 62 | 2609 |
| 1157757 | 4183 | 4198 | 4383 | 4398 | CTCTATACTTTGAAGG | 80 | 2610 |
| 1157790 | 4261 | 4276 | 4461 | 4476 | GCATTTCCCATAATTG | 54 | 2611 |
| 1157824 | 4426 | 4441 | 4626 | 4641 | GAATCTTACTTGATAA | 87 | 2612 |
| 1157857 | 4613 | 4628 | 4812 | 4827 | CTCTAAGAGACATTCA | 77 | 2613 |
| 1157923 | 4814 | 4829 | 5013 | 5028 | GAATCTCAGGGTTATG | 43 | 2614 |
| 1157957 | 4902 | 4917 | 5101 | 5116 | AAATGGTAGATTCCGT | 40 | 2615 |
| 1157991 | 5049 | 5064 | 5248 | 5263 | GGATTAATGTAGTGTA | 14 | 2616 |
| 1158024 | 5135 | 5150 | 5334 | 5349 | CAAACGAAACATTGGC | 69 | 2617 |
| 1158057 | 5219 | 5234 | 5418 | 5433 | TATCTGTTAACAGCTG | 59 | 2618 |
| 1158090 | 5285 | 5300 | 5484 | 5499 | AACTCCACAGCTCTTA | N.D. | 2619 |
| 1158122 | 5387 | 5402 | 5586 | 5601 | GAACAAGTCCTACAAT | 68 | 2620 |
| 1158155 | 5485 | 5500 | 5684 | 5699 | GCATCAAGGCACTGAT | 65 | 2621 |
| 1158189 | 5574 | 5589 | 5773 | 5788 | TAGCAGTAACATCTGA | 54 | 2622 |
| 1158222 | 5772 | 5787 | 5971 | 5986 | GTGTTCGCAGACAAAG | 90 | 2623 |
| 1158255 | 5894 | 5909 | 6093 | 6108 | CTCTATTGCCATGTGC | 43 | 2624 |
| 1158288 | 5991 | 6006 | 6190 | 6205 | ACCCCTGACTTTCTGG | 82 | 2625 |
| 1158322 | 6079 | 6094 | 6278 | 6293 | TACCACTCTAAGATTG | 95 | 2626 |
| 1158356 | 6194 | 6209 | 6393 | 6408 | CAAAATCCTGAATGGC | 90 | 2627 |
| 1158389 | 6323 | 6338 | 6522 | 6537 | GTAAGCCCCACCCCCT | 135 | 2628 |
| 1158422 | 6435 | 6450 | 6634 | 6649 | AGCAGCGGGATCAGAA | 81 | 2629 |
| 1158454 | 6536 | 6551 | 6735 | 6750 | TTTATCACTCAGCTGG | 47 | 2630 |
| 1158487 | 6694 | 6709 | 6893 | 6908 | TTAAGGTTGCATCTGG | 35 | 2631 |
| 1158518 | 6966 | 6981 | 7165 | 7180 | TAGTGGTTCCCAATCC | 86 | 2632 |
| 1158551 | 7060 | 7075 | 7259 | 7274 | GAAAAAGCTTGTTCAC | 72 | 2633 |
| 1158585 | 7151 | 7166 | 7350 | 7365 | AGTTTGCTCACATGCC | 35 | 2634 |
| 1158617 | 7305 | 7320 | 7504 | 7519 | ACCTTAGGATAATAGC | 61 | 2635 |
| 1158651 | 7398 | 7413 | 7597 | 7612 | CAAGCATTCCTTCGGA | 75 | 2636 |
| 1158684 | 7521 | 7536 | 7720 | 7735 | AAAGTGGTTGCCCGCT | 85 | 2637 |
| 1158718 | 7653 | 7668 | 7852 | 7867 | CCAAGCTACTGGCTGC | 77 | 2638 |
| 1158752 | 7707 | 7722 | 7906 | 7921 | GACCTCGACACCATCG | 56 | 2639 |

TABLE 64-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 1158784 | 7774 | 7789 | 7973 | 7988 | AATACCCTTCTGTTAA | 84 | 2640 |
| 1158818 | 7870 | 7885 | 8069 | 8084 | TTACAGTTCTTGAACA | 75 | 2641 |
| 1158851 | 7947 | 7962 | 8146 | 8161 | ATTCCCACCCAAAAGC | N.D. | 2642 |
| 1158884 | 8039 | 8054 | 8238 | 8253 | CTGAAGAGCATTGGAG | 50 | 2643 |
| 1158949 | 8327 | 8342 | 8526 | 8541 | AAGGATGTATATAGTT | 79 | 2644 |
| 1158983 | 8422 | 8437 | 8621 | 8636 | GCAGGCTATTACCTGA | 81 | 2645 |
| 1159016 | 1005 | 1020 | N/A | N/A | CACCTTCCGCCGCCTC | 72 | 2646 |

Example 14: Design of Gapmers with 2'-O Methyl Modifications Complementary to Human MALAT1 RNA Modified oligonucleotides complementary to human a MALAT1 nucleic acid were designed. The modified oligonucleotides in the table below are 3-10-3 cET gapmers. The gapmers are 16 nucleosides in length, wherein the central gap segment comprises of a combination of one 2'-O-methyl nucleoside and nine 2'-deoxynucleosides. The central gap segment is flanked by wing segments on the 5' direction and the 3' direction comprising three nucleosides each. Each nucleoside in the 5' wing segment and each nucleoside in the 3' wing segment has a cEt sugar modification. The internucleoside linkages throughout each gapmer are phosphorothioate (P=S) linkages. The sequence and chemical notation column specifies the sequence, including 5-methylcytosines, sugar chemistry, and the internucleoside linkage chemistry; wherein subscript 'd' represents a 2'-β-D-deoxyribosyl sugar moiety, subscript 'k' represents a cET sugar moiety, subscript 's' represents to a phosphorothioate internucleoside linkage, superscript 'm' before the cytosine residue represents a 5-methylcytosine, and subscript 'y' represents a 2'-OMe sugar moiety. "Start site" indicates the 5'-most nucleoside to which the gapmer is complementary in the human nucleic acid sequence. "Stop site" indicates the 3'-most nucleoside to which the gapmer is complementary in the human nucleic acid sequence.

Each modified oligonucleotide listed in the table below is complementary to human MALAT1 nucleic acid sequence SEQ ID NO: 1 (GENBANK Accession No: XR_001309.1).

TABLE 65 cET gapmers with 2'-OMe sugars complementary to human MALAT1

| Compound Number | SEQ ID NO: 1 Start Site | SEQ ID NO: 1 Stop Site | Sequence (5' to 3') | Chemistry Notation (5' to 3') | SEQ ID No. |
|---|---|---|---|---|---|
| 1304879 | 2033 | 2048 | GTTACCAATAATTTCC | $G_{ks}T_{ks}T_{ks}A_{ds}C_{ys}{}^mC_{ds}A_{ds}A_{ds}T_{ds}A_{ds}A_{ds}T_{ds}T_{ds}T_{ks}{}^mC_{ks}{}^mC_k$ | 1592 |
| 1304880 | 5078 | 5093 | TCTCATTTATTTCGGC | $T_{ks}{}^mC_{ks}T_{ks}{}^mC_{ds}A_{ys}T_{ds}T_{ds}T_{ds}A_{ds}T_{ds}T_{ds}T_{ds}{}^mC_{ds}G_{ks}G_{ks}{}^mC_k$ | 1077 |
| 1304881 | 5494 | 5509 | CCTTAGTTGGCATCAA | ${}^mC_{ks}{}^mC_{ks}T_{ks}T_{ds}A_{ys}G_{ds}T_{ds}T_{ds}G_{ds}G_{ds}{}^mC_{ds}A_{ds}T_{ds}{}^mC_{ks}A_{ks}A_k$ | 6 |
| 1304882 | 5419 | 5434 | GAAGUGTACTATCCCA | $G_{ks}A_{ks}A_{ks}G_{ds}U_{ys}G_{ds}T_{ds}A_{ds}{}^mC_{ds}T_{ds}A_{ds}T_{ds}{}^mC_{ds}{}^mC_{ks}{}^mC_{ks}A_k$ | 2647 |
| 1304883 | 5074 | 5089 | ATTTATTTCGGCTTCT | $A_{ks}T_{ks}T_{ks}T_{ds}A_{ys}T_{ds}T_{ds}T_{ds}{}^mC_{ds}G_{ds}G_{ds}{}^mC_{ds}T_{ds}T_{ks}{}^mC_{ks}T_k$ | 850 |
| 1304885 | 4938 | 4953 | TTTTUGTGGTTATAGC | $T_{ks}T_{ks}T_{ks}T_{ds}U_{ys}G_{ds}T_{ds}G_{ds}G_{ds}T_{ds}T_{ds}A_{ds}T_{ds}A_{ks}G_{ks}{}^mC_k$ | 2648 |
| 1304886 | 4903 | 4918 | AAAAUGGTAGATTCCG | $A_{ks}A_{ks}A_{ks}A_{ds}U_{ys}G_{ds}G_{ds}T_{ds}A_{ds}G_{ds}A_{ds}T_{ds}T_{ds}{}^mC_{ks}{}^mC_{ks}G_k$ | 2649 |
| 1304887 | 4935 | 4950 | TTGTGGTTATAGCTTG | $T_{ks}T_{ks}G_{ks}T_{ds}G_{ys}G_{ds}T_{ds}T_{ds}A_{ds}T_{ds}A_{ds}G_{ds}{}^mC_{ds}T_{ks}T_{ks}G_k$ | 1232 |
| 1304888 | 4933 | 4948 | GTGGUTATAGCTTGAC | $G_{ks}T_{ks}G_{ks}G_{ds}U_{ys}T_{ds}A_{ds}T_{ds}A_{ds}G_{ds}{}^mC_{ds}T_{ds}T_{ds}G_{ks}A_{ks}{}^mC_k$ | 2650 |
| 1304889 | 4808 | 4823 | CAGGGTTATGCTTATT | ${}^mC_{ks}A_{ks}G_{ks}G_{ds}G_{ys}T_{ds}T_{ds}A_{ds}T_{ds}G_{ds}{}^mC_{ds}T_{ds}T_{ds}A_{ks}T_{ks}T_k$ | 2152 |
| 1304891 | 2034 | 2049 | GGTTACCAATAATTTC | $G_{ks}G_{ks}T_{ks}T_{ds}A_{ys}{}^mC_{ds}{}^mC_{ds}A_{ds}A_{ds}T_{ds}A_{ds}A_{ds}T_{ds}T_{ks}T_{ks}{}^mC_k$ | 3 |
| 1304892 | 2341 | 2356 | TGGTAATTACTCTTGA | $T_{ks}G_{ks}G_{ks}T_{ds}A_{ys}A_{ds}T_{ds}T_{ds}A_{ds}{}^mC_{ds}T_{ds}{}^mC_{ds}T_{ds}T_{ks}G_{ks}A_k$ | 4 |
| 1304893 | 1533 | 1548 | CGGTUTAATCTCTTTT | ${}^mC_{ks}G_{ks}G_{ks}T_{ds}U_{ys}T_{ds}A_{ds}A_{ds}T_{ds}{}^mC_{ds}T_{ds}{}^mC_{ds}T_{ds}T_{ks}T_{ks}T_k$ | 2651 |

TABLE 65-continued cET gapmers with 2'-OMe sugars complementary to human MALAT1

| Compound Number | SEQ ID NO: 1 Start Site | SEQ ID NO: 1 Stop Site | Sequence (5' to 3') | Chemistry Notation (5' to 3') | SEQ ID No. |
|---|---|---|---|---|---|
| 1304894 | 7290 | 7305 | CGCTUTGTTGTCTCTC | $^{m}C_{ks}G_{ks}{}^{m}C_{ks}T_{ds}U_{ys}T_{ds}G_{ds}T_{ds}T_{ds}G_{ds}T_{ds}{}^{m}C_{ds}T_{ds}{}^{m}C_{ks}T_{ks}{}^{m}C_{k}$ | 2652 |
| 1304895 | 7835 | 7850 | GGTTUAAGTTGGTTTT | $G_{ks}G_{ks}T_{ks}T_{ds}U_{ys}A_{ds}A_{ds}G_{ds}T_{ds}T_{ds}G_{ds}G_{ds}T_{ds}T_{ks}T_{ks}T_{k}$ | 2653 |
| 1304896 | 7825 | 7840 | GGTTUTAGTCACTGGA | $G_{ks}G_{ks}T_{ks}T_{ds}U_{ys}T_{ds}A_{ds}G_{ds}T_{ds}{}^{m}C_{ds}A_{ds}{}^{m}C_{ds}T_{ds}G_{ks}G_{ks}A_{k}$ | 2654 |
| 1304897 | 7289 | 7304 | GCTTUGTTGTCTCTCC | $G_{ks}{}^{m}C_{ks}T_{ks}T_{ds}U_{ys}G_{ds}T_{ds}T_{ds}G_{ds}T_{ds}{}^{m}C_{ds}T_{ds}{}^{m}C_{ds}T_{ks}{}^{m}C_{ks}{}^{m}C_{k}$ | 2655 |
| 1304898 | 5495 | 5510 | TCCTUAGTTGGCATCA | $T_{ks}{}^{m}C_{ks}{}^{m}C_{ks}T_{ds}U_{ys}A_{ds}G_{ds}T_{ds}T_{ds}G_{ds}G_{ds}{}^{m}C_{ds}A_{ds}T_{ks}{}^{m}C_{ks}A_{k}$ | 2656 |
| 1304899 | 6700 | 6715 | CTGAUTTTAAGGTTGC | $^{m}C_{ks}T_{ks}G_{ks}A_{ds}U_{ys}T_{ds}T_{ds}T_{ds}A_{ds}A_{ds}G_{ds}G_{ds}T_{ds}T_{ks}G_{ks}{}^{m}C_{k}$ | 2657 |
| 1304900 | 6699 | 6714 | TGATUTTAAGGTTGCA | $T_{ks}G_{ks}A_{ks}T_{ds}U_{ys}T_{ds}T_{ds}A_{ds}A_{ds}G_{ds}G_{ds}T_{ds}T_{ds}G_{ks}{}^{m}C_{ks}A_{k}$ | 2658 |
| 1304901 | 5525 | 5540 | AGCCUTCAGAGATTCA | $A_{ks}G_{ks}{}^{m}C_{ks}{}^{m}C_{ds}U_{ys}T_{ds}{}^{m}C_{ds}A_{ds}G_{ds}A_{ds}G_{ds}A_{ds}T_{ds}T_{ks}{}^{m}C_{ks}A_{k}$ | 2659 |
| 1304902 | 5050 | 5065 | AGGAUTAATGTAGTGT | $A_{ks}G_{ks}G_{ks}A_{ds}U_{ys}T_{ds}A_{ds}A_{ds}T_{ds}G_{ds}T_{ds}A_{ds}G_{ds}T_{ks}G_{ks}T_{k}$ | 2660 |
| 1304903 | 5051 | 5066 | CAGGATTAATGTAGTG | $^{m}C_{ks}A_{ks}G_{ks}G_{ds}A_{ys}T_{ds}T_{ds}A_{ds}A_{ds}T_{ds}G_{ds}T_{ds}A_{ds}G_{ks}T_{ks}G_{k}$ | 161 |
| 1304904 | 4821 | 4836 | GTAGUAAGAATCTCAG | $G_{ks}T_{ks}A_{ks}G_{ds}U_{ys}A_{ds}A_{ds}G_{ds}A_{ds}A_{ds}T_{ds}{}^{m}C_{ds}T_{ds}{}^{m}C_{ks}A_{ks}G_{k}$ | 2661 |
| 1304905 | 1564 | 1579 | GTCAUGGATTTCAAGG | $G_{ks}T_{ks}{}^{m}C_{ks}A_{ds}U_{ys}G_{ds}G_{ds}A_{ds}T_{ds}T_{ds}T_{ds}{}^{m}C_{ds}sA_{ds}A_{ks}G_{ks}G_{k}$ | 2662 |
| 1304907 | 1535 | 1550 | TTCGGTTTAATCTCTT | $T_{ks}T_{ks}{}^{m}C_{ks}G_{ds}G_{ys}T_{ds}T_{ds}T_{ds}A_{ds}A_{ds}T_{ds}{}^{m}C_{ds}T_{ds}{}^{m}C_{ks}T_{ks}T_{k}$ | 2 |
| 1304908 | 4932 | 4947 | TGGTUATAGCTTGACA | $T_{ks}G_{ks}G_{ks}T_{ds}U_{ys}A_{ds}T_{ds}A_{ds}G_{ds}{}^{m}C_{ds}T_{ds}T_{ds}G_{ds}A_{ks}{}^{m}C_{ks}A_{k}$ | 2663 |

Example 15: Antisense Inhibition of Human MALAT1 in HepG2 Cells by 3-10-3 cEt Gapmers Modified oligonucleotides complementary to a MALAT1 nucleic acid were synthesized and tested for their effect on MALAT1 RNA levels in vitro in comparison with comparator compounds 395240 and 556089 described above. The modified oligonucleotides were tested in a series of experiments using the same culture conditions. The results for each separate experiment are presented in separate tables below.

Except for comparator compound 395240, which is a 5-10-5 MOE gapmer (i.e., it has a central gap segment of ten 2'-deoxynucleosides flanked on each side by wing segments, each comprising five 2'-O-methoxyethyl modified nucleosides), the modified oligonucleotides are all 3-10-3 cEt gapmers (i.e., they have a central gap segment of ten 2'-deoxynucleosides flanked on each side by wing segments, each comprising three cEt modified nucleosides). The internucleoside linkages throughout each modified oligonucleotide are phosphorothioate (P=S) linkages. All cytosine nucleobases throughout each modified oligonucleotide are 5-methylcytosines.

"Start site" indicates the 5'-most nucleoside of the target sequence to which the modified oligonucleotide is complementary. "Stop site" indicates the 3'-most nucleoside of the target sequence to which the modified oligonucleotide is complementary. As shown in the tables below, the modified oligonucleotides are 100% complementary to either the human MALAT1 RNA transcript, designated herein as SEQ ID NO: 1 (GENBANK Accession No. XR_001309.1) or the human MALAT1 RNA transcript designated here in as SEQ ID NO: 2824 (GENBANK Accession No. EF177381.1). 'N/A' indicates that the modified oligonucleotide is not complementary to that particular target sequence with 100% complementarity.

Cultured HepG2 cells at a density of 20,000 cells per well were transfected using electroporation with 300 nM of modified oligonucleotide. After an overnight incubation, RNA was isolated from the cells and MALAT1 RNA levels were measured by quantitative real-time RTPCR. Human primer probe set RTS2738 (forward sequence GAAT-TGCGTCATTTAAAGCCTAGTT, designated herein as SEQ ID NO: 2820; reverse sequence TCATCCTAC-CACTCCCAATTAATCT, designated herein as SEQ ID NO: 2821; probe sequence ACGCATTTACTAAACGCA-GACGAAAATGGA, designated herein as SEQ ID NO: 2822) was used to measure RNA levels. MALAT1 RNA levels were normalized to total RNA content, as measured by RIBOGREEN®. Results are presented as percent change of MALAT1 RNA, relative to PBS control. The symbol "‡" indicates that the modified oligonucleotide is complementary to the target transcript within the amplicon region of the primer probe set and so the associated data is not reliable. In such instances, additional assays using alternative primer probes must be performed to accurately assess the potency and efficacy of such modified oligonucleotides.

TABLE 66

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395240 | 3320 | 3339 | 3520 | 3539 | TGCCTTTAGGATTCTAGACA | 51 | 11 |
| 556032 | 3310 | 3325 | 3510 | 3525 | TAGACAGACCTAAGGG | 22 | 2664 |
| 556089 | 6445 | 6460 | 6644 | 6659 | GCATTCTAATAGCAGC | 6 | 31 |
| 556130 | 8007 | 8022 | 8206 | 8221 | ATGCTAGCTTGGCCAA | 17 | 2665 |
| 559466 | 36 | 51 | 2 | 17 | GGGCCCCAGTCCTTTA | 86 | 2666 |
| 559467 | 177 | 192 | 143 | 158 | CGTCCCAAGGACTCTG | 105 | 2667 |
| 559468 | 281 | 296 | 247 | 262 | ACCCCAAGACCAAACT | 93 | 2668 |
| 559469 | 412 | 427 | 378 | 393 | AAGTGTTTACACTGCT | 74 | 2669 |
| 559470 | 522 | 537 | 488 | 503 | ATCGCCATGGAAAGCG | 95 | 2670 |
| 559471 | 636 | 651 | 602 | 617 | GTGGCCCACTCTGATC | 87 | 2671 |
| 559472 | 760 | 775 | 726 | 741 | TCGGAGCAGCACGGGC | 77 | 2672 |
| 559473 | 868 | 883 | 834 | 849 | CAGGGACGGTTGAGAA | 91 | 2673 |
| 559474 | 968 | 983 | 934 | 949 | CTTGAGGGACAGTAGG | 84 | 2674 |
| 559475 | N/A | N/A | 1051 | 1066 | TTGAGCTGCAAACTTT | 119 | 2675 |
| 559476 | N/A | N/A | 1162 | 1177 | GGTTAAAAATAGGTTC | 73 | 2676 |
| 559477 | 1063 | 1078 | 1263 | 1278 | ACAGCTCGGGCGAGGC | 74 | 2677 |
| 559478 | 1199 | 1214 | 1399 | 1414 | ACCTATTGACTATATT | 33 | 2678 |
| 559479 | 1415 | 1430 | 1615 | 1630 | TTGGTATTAATTCGGG | 8 | 2679 |
| 559480 | 1561 | 1576 | 1761 | 1776 | ATGGATTTCAAGGTCT | 7 | 2680 |
| 559481 | 1690 | 1705 | 1890 | 1905 | GTTTTCCACTTCAAAC | 35 | 2681 |
| 559482 | 1953 | 1968 | 2153 | 2168 | CAATACTTGTCTTAGC | 13 | 2682 |
| 559484 | 2178 | 2193 | 2378 | 2393 | GTGATTTTTAACCAAC | 7 | 2683 |
| 559485 | 2399 | 2414 | 2599 | 2614 | TAGTCCTCAGGATTTA | 21 | 2684 |
| 559486 | 2503 | 2518 | 2703 | 2718 | CTAGCTTCATCAAACA | 22 | 2685 |
| 559487 | 2626 | 2641 | 2826 | 2841 | CTTCACCACCAAATCG | 20 | 2686 |
| 559488 | 2752 | 2767 | 2952 | 2967 | GCATGCTGGTCTAGGA | 22 | 2687 |
| 559489 | 2789 | 2804 | 2989 | 3004 | ACCAACCACTCGCTTT | 22 | 2688 |
| 559490 | 2889 | 2904 | 3089 | 3104 | CACCTCAGTACGAAAC | 42 | 2689 |
| 559491 | 2985 | 3000 | 3185 | 3200 | CTCAAAAGCTTCAGAC | 29 | 2690 |
| 559492 | 2997 | 3012 | 3197 | 3212 | TGGCAGTCTGCCCTCA | 22 | 2691 |
| 559493 | 3166 | 3181 | 3366 | 3381 | GTCATCTATTCACAAA | 8 | 2692 |
| 559494 | 3322 | 3337 | 3522 | 3537 | CCTTTAGGATTCTAGA | 17 | 2693 |
| 559495 | 3435 | 3450 | 3635 | 3650 | TCCACAGACCTCAACG | 17 | 2694 |
| 559496 | 3502 | 3517 | 3702 | 3717 | AAAGTCTGATTAAGGG | 18 | 2695 |
| 559497 | 3629 | 3644 | 3829 | 3844 | AGTACTATAGCATCTG | 8 | 32 |
| 559498 | 3720 | 3735 | 3920 | 3935 | ACTCTTCCAAGGATAA | 17 | 2696 |
| 559499 | 3766 | 3781 | 3966 | 3981 | GAACCAAAGCTGCACT | 17 | 2697 |

TABLE 66-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 559500 | 3884 | 3899 | 4084 | 4099 | GCCAATATTTGCCCCT | 22 | 2698 |
| 559501 | 4022 | 4037 | 4222 | 4237 | TGGAAGTTGATATTTC | 10 | 2699 |
| 559502 | 4080 | 4095 | 4280 | 4295 | GCTTCCCAATTCAAAC | 37 | 2700 |
| 559503 | 4182 | 4197 | 4382 | 4397 | TCTATACTTTGAAGGA | 33 | 2701 |
| 559504 | 4295 | 4310 | 4495 | 4510 | GAGAACCACACACTAC | 23 | 2702 |
| 559505 | 4405 | 4420 | 4605 | 4620 | AAGCTACCATCAGAAG | 29 | 2703 |
| 559506 | 4575 | 4590 | 4774 | 4789 | ATCAGTTACAATTTAC | 12 | 2704 |
| 559507 | 4629 | 4644 | 4828 | 4843 | TCAACAAAAGCCCACC | 48 | 2705 |
| 559508 | 4687 | 4702 | 4886 | 4901 | CTCAGAAGATGTTATC | 19 | 2706 |
| 559509 | 4748 | 4763 | 4947 | 4962 | CAATTCACCAAGGAGC | 10 | 2707 |
| 559510 | 4845 | 4860 | 5044 | 5059 | CATATGCAGATAATGT | 12 | 2708 |
| 559511 | 4976 | 4991 | 5175 | 5190 | GACATTGCCTCTTCAT | 4 | 2709 |
| 559512 | 5041 | 5056 | 5240 | 5255 | GTAGTGTAACATTTTC | 3 | 2710 |
| 559513 | 5131 | 5146 | 5330 | 5345 | CGAAACATTGGCACAC | 10 | 2711 |
| 559514 | 5142 | 5157 | 5341 | 5356 | TCTGAGGCAAACGAAA | 37 | 2712 |
| 559515 | 5229 | 5244 | 5428 | 5443 | AAGTTAAACTTATCTG | 38 | 2713 |
| 559516 | 5257 | 5272 | 5456 | 5471 | TATCCCTAACATGCAA | 28 | 2714 |
| 559517 | 5359 | 5374 | 5558 | 5573 | CGATGGAAAAATTTCT | 20 | 2715 |
| 559518 | 5466 | 5481 | 5665 | 5680 | TTTAGAGGCTTTTAAG | 60 | 2716 |
| 559519 | 5569 | 5584 | 5768 | 5783 | GTAACATCTGATTCTA | 9 | 2717 |
| 559520 | 5721 | 5736 | 5920 | 5935 | TGCCCCAACACTGAAC | 42 | 2718 |
| 559521 | 5795 | 5810 | 5994 | 6009 | ATCCTGATCTGGTCCA | 27 | 2719 |
| 559523 | 5830 | 5845 | 6029 | 6044 | TCCTGCCTTAAAGTTA | 61 | 2720 |
| 559525 | 5928 | 5943 | 6127 | 6142 | GTCTAAGAGGTTATTT | 29 | 2721 |
| 559527 | 6061 | 6076 | 6260 | 6275 | AGCATTTAAAGTTAAC | 19 | 2722 |
| 559529 | 6169 | 6184 | 6368 | 6383 | GATGAAATGCCTCTGC | 14 | 2723 |
| 559531 | 6259 | 6274 | 6458 | 6473 | AACTCACTGCAAGGTC | 15 | 2724 |
| 559533 | 6385 | 6400 | 6584 | 6599 | ACCTGAAGTCAAGACA | 18 | 2725 |
| 559535 | 6532 | 6547 | 6731 | 6746 | TCACTCAGCTGGATTT | 16 | 2726 |
| 559537 | 6582 | 6597 | 6781 | 6796 | CAAATACGACTGCTTA | 62 | 2727 |
| 559539 | 6849 | 6864 | 7048 | 7063 | TGTTCCTGCATGTAAG | 47 | 2728 |
| 559541 | 6964 | 6979 | 7163 | 7178 | GTGGTTCCCAATCCCC | 21 | 2729 |
| 559543 | 7143 | 7158 | 7342 | 7357 | CACATGCCAGTTACTC | 12 | 2730 |
| 559545 | 7231 | 7246 | 7430 | 7445 | GTGCCTTTAGTGAGGG | 23 | 2731 |
| 559547 | 7404 | 7419 | 7603 | 7618 | GTACTTCAAGCATTCC | 8 | 2732 |
| 559549 | 7519 | 7534 | 7718 | 7733 | AGTGGTTGCCCGCTTT | 16 | 2733 |

TABLE 66-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 559551 | 7748 | 7763 | 7947 | 7962 | GCAAATTAATGGCCTT | 8 | 2734 |
| 559553 | 7871 | 7886 | 8070 | 8085 | ATTACAGTTCTTGAAC | 28 | 2735 |
| 559556 | 8158 | 8173 | 8357 | 8372 | TGCCAACCACCAGCAT | 81 | 2736 |
| 559557 | 8209 | 8224 | 8408 | 8423 | GTCAAAGCAAAGACGC | 82 | 2737 |
| 559559 | 8378 | 8393 | 8577 | 8592 | CGTGTAAATATGAATA | 55 | 2738 |

TABLE 67

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 395240 | 3320 | 3339 | 3520 | 3539 | TGCCTTTAGGATTCTAGACA | 49 | 11 |
| 556057 | 4700 | 4715 | 4899 | 4914 | AGGCTGGTTATGACTC | 10 | 2739 |
| 559522 | 84 | 99 | 50 | 65 | GTTGCTAAAATGGCGC | 82 | 2740 |
| 559524 | 229 | 244 | 195 | 210 | TGGAATGGCCAGCCTA | 79 | 2741 |
| 559526 | 337 | 352 | 303 | 318 | ATGAGCTTCAGACCTT | 78 | 2742 |
| 559528 | 472 | 487 | 438 | 453 | CGAATGGCTTTGTCTC | 84 | 2743 |
| 559530 | 579 | 594 | 545 | 560 | GAAATTTTCTACCGT | 92 | 2744 |
| 559532 | 710 | 725 | 676 | 691 | CACTCTTGGAAAACGC | 91 | 2745 |
| 559534 | 816 | 831 | 782 | 797 | CAGTCCTGCGACTTGC | 98 | 2746 |
| 559536 | 918 | 933 | 884 | 899 | GTGATAGTTCAGGGCT | 103 | 2747 |
| 559538 | N/A | N/A | 1001 | 1016 | GGTCATCAAACACCTC | 70 | 2748 |
| 559540 | N/A | N/A | 1110 | 1125 | GGAACTTGAATGCAAA | 75 | 2749 |
| 559542 | N/A | N/A | 1200 | 1215 | TCCGCCGCCTTTGTGA | 69 | 2750 |
| 559544 | 1131 | 1146 | 1331 | 1346 | CGGTTTCCTCAAGCTC | 4 | 2751 |
| 559546 | 1326 | 1341 | 1526 | 1541 | CGTCATGTTTTAGAAA | 11 | 2752 |
| 559548 | 1509 | 1524 | 1709 | 1724 | CGCCTTCAAATTATTT | 8 | 2753 |
| 5595501 | 1660 | 1675 | 1860 | 1875 | AATTGTTTCATCCTAC | 47 | 2754 |
| 559552 | 1852 | 1867 | 2052 | 2067 | ACATTTTGCCCTTAGC | 10 | 2755 |
| 559554 | 2006 | 2021 | 2206 | 2221 | GTGCTATTTTATCCAA | 4 | 2756 |
| 559555 | 2116 | 2131 | 2316 | 2331 | GTAAACACCCTCATCT | 27 | 2757 |
| 559558 | 2267 | 2282 | 2467 | 2482 | TAAGGCCTTCCAAATT | 27 | 2758 |
| 559560 | 2448 | 2463 | 2648 | 2663 | TCACTGAATCCACTTC | 12 | 2759 |
| 559561 | 2576 | 2591 | 2776 | 2791 | CAAATCGCACTGGCTC | 10 | 2760 |
| 559562 | 2679 | 2694 | 2879 | 2894 | GCTACCTTCATCACCA | 32 | 2761 |
| 559563 | 2758 | 2773 | 2958 | 2973 | ACACTGGCATGCTGGT | 20 | 2762 |
| 559564 | 2839 | 2854 | 3039 | 3054 | CCATAAGTAAGTTCCA | 7 | 36 |

TABLE 67-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 559565 | 2939 | 2954 | 3139 | 3154 | AAACCTACAACACCCG | 26 | 2763 |
| 559566 | 2992 | 3007 | 3192 | 3207 | GTCTGCCCTCAAAAGC | 19 | 2764 |
| 559567 | 3063 | 3078 | 3263 | 3278 | GTTTTCCTCAAATTCG | 9 | 2765 |
| 559568 | 3225 | 3240 | 3425 | 3440 | AGTTACACATCCAAAC | 22 | 2766 |
| 559569 | 3315 | 3330 | 3515 | 3530 | GATTCTAGACAGACCT | 79 | 2767 |
| 559570 | 3370 | 3385 | 3570 | 3585 | ATCCTGATATTGGATT | 65 | 2768 |
| 559571 | 3467 | 3482 | 3667 | 3682 | AACTACCAGCCATTTC | 31 | 2769 |
| 559572 | 3555 | 3570 | 3755 | 3770 | ATCCCAAAATGCTTCA | 22 | 2770 |
| 559573 | 3695 | 3710 | 3895 | 3910 | CAGTCCCTGAAGGTGT | 20 | 2771 |
| 559574 | 3743 | 3758 | 3943 | 3958 | ACTTTTCAGCTTCAAC | 18 | 2772 |
| 559575 | 3814 | 3829 | 4014 | 4029 | TTTGGCCTACTCAAGC | 20 | 2773 |
| 559577 | 4038 | 4053 | 4238 | 4253 | GAGTTACTTGCCAACT | 21 | 2774 |
| 559578 | 4131 | 4146 | 4331 | 4346 | GCCCAAATTAATGCAC | 32 | 2775 |
| 559579 | 4232 | 4247 | 4432 | 4447 | CCCAGTAGGCCAGACC | 15 | 2776 |
| 559580 | 4350 | 4365 | 4550 | 4565 | CAGTTTCTATAGTAGT | 11 | 2777 |
| 559581 | 4495 | 4510 | 4694 | 4709 | GCAGTTAAACAATGGA | 6 | 2778 |
| 559582 | 4624 | 4639 | 4823 | 4838 | AAAAGCCCACCCTCTA | 60 | 2779 |
| 559583 | 4634 | 4649 | 4833 | 4848 | CCTCATCAACAAAAGC | 55 | 2780 |
| 559584 | 4798 | 4813 | 4997 | 5012 | CTTATTCCCCAATGGA | 14 | 2781 |
| 559585 | 4899 | 4914 | 5098 | 5113 | TGGTAGATTCCGTAAC | 6 | 2782 |
| 559586 | 5004 | 5019 | 5203 | 5218 | GCTTTTGTAAAAGCAG | 66 | 2783 |
| 559587 | 5092 | 5107 | 5291 | 5306 | GATCCCAACTCATCTC | 8 | 2784 |
| 559588 | 5136 | 5151 | 5335 | 5350 | GCAAACGAAACATTGG | 8 | 2785 |
| 559589 | 5178 | 5193 | 5377 | 5392 | AATGAAGCAACTCTTC | 42 | 2786 |
| 559590 | 5250 | 5265 | 5449 | 5464 | AACATGCAATACTGCA | 8 | 2787 |
| 559591 | 5303 | 5318 | 5502 | 5517 | CCATGGTTGATATTTA | 16 | 2788 |
| 559592 | 5411 | 5426 | 5610 | 5625 | CTATCCCATCACTGAA | 19 | 2789 |
| 559593 | 5516 | 5531 | 5715 | 5730 | AGATTCAATGCTAAAC | 13 | 2790 |
| 559594 | 5658 | 5673 | 5857 | 5872 | GTATACATTCTCTAAT | 52 | 2791 |
| 559595 | 5771 | 5786 | 5970 | 5985 | TGTTCGCAGACAAAGT | 14 | 2792 |
| 559596 | 5824 | 5839 | 6023 | 6038 | CTTAAAGTTACATTCG | 9 | 2793 |
| 559597 | 5875 | 5890 | 6074 | 6089 | GAATTATTATATGCTC | 12 | 2794 |
| 559598 | 5994 | 6009 | 6193 | 6208 | TAGACCCCTGACTTTC | 8 | 2795 |
| 559599 | 6111 | 6126 | 6310 | 6325 | CCTATATAAGGTCAAT | 39 | 2796 |
| 559600 | 6241 | 6256 | 6440 | 6455 | ATACACTCACTAGAAC | 55 | 2797 |
| 559601 | 6327 | 6342 | 6526 | 6541 | ACAAGTAAGCCCCACC | 75 | 2798 |

TABLE 67-continued

Inhibition of MALAT1 RNA by 3-10-3 cEt gapmers

| Compound Number | SEQ ID NO: 1 Start Site | SEQ ID NO: 1 Stop Site | SEQ ID NO: 2824 Start Site | SEQ ID NO: 2824 Stop Site | Sequence (5' to 3') | MALAT1 (% UTC) | SEQ ID No. |
|---|---|---|---|---|---|---|---|
| 559602 | 6428 | 6443 | 6627 | 6642 | GGATCAGAACAGTACT | 15 | 2799 |
| 559603 | 6452 | 6467 | 6651 | 6666 | TCACAATGCATTCTAA | 28 | 2800 |
| 559604 | 6554 | 6569 | 6753 | 6768 | TTTCCTCAACACTCAG | 19 | 2801 |
| 559605 | 6677 | 6692 | 6876 | 6891 | AAAGACTAAAGGCTTC | 19 | 2802 |
| 559606 | 6921 | 6936 | 7120 | 7135 | TTAAAGTAAATAGGCT | 38 | 2803 |
| 559607 | 7032 | 7047 | 7231 | 7246 | TTTTGTCCACTGGTGA | 16 | 2804 |
| 559609 | 7303 | 7318 | 7502 | 7517 | CTTAGGATAATAGCGC | 6 | 2805 |
| 559610 | 7454 | 7469 | 7653 | 7668 | TAAGAGCTGCTATAAA | 85 | 2806 |
| 559611 | 7641 | 7656 | 7840 | 7855 | CTGCATCGAGGTGAGG | 19 | 2807 |
| 559612 | 7799 | 7814 | 7998 | 8013 | AATAGAGCTACTTAGC | 28 | 2808 |
| 559613 | 7974 | 7989 | 8173 | 8188 | GAAAAAGTCTTAGCAG | 33 | 2809 |
| 559614 | 8054 | 8069 | 8253 | 8268 | ACCTTCATGACCCTAC | 65 | 2810 |
| 559615 | 8181 | 8196 | 8380 | 8395 | AACCCCGTCCTGGAAA | 83 | 2811 |
| 559616 | 8316 | 8331 | 8515 | 8530 | TAGTTCAAAGATATTG | 93 | 2812 |
| 559617 | 8446 | 8461 | 8645 | 8660 | GTAGGGCTTCTCAAAA | 111 | 2813 |

Example 16: Dose-Dependent Inhibition of Human MALAT1 in A431 Cells by 3-10-3 cEt Gapmers Certain modified oligonucleotides described in the studies above exhibiting significant in vitro inhibition of MALAT1 RNA were selected and tested at various doses in A431 cells in comparison with comparator compounds 395240, 395243, 395244, 395248, 395253, 395254, 395255, 395256, 395280, 556089, and 559497 described above.

The modified oligonucleotides were tested in a series of experiments using the same culture conditions. The results for each experiment are presented in separate tables shown below. Cultured A431 cells at a density of 10,000 cells per well were transfected using free uptake with modified oligonucleotides diluted to different concentrations as specified in the tables below. After a treatment period of approximately 48 hours, RNA levels were measured as previously described using the Human primer-probe set RTS2736. MALAT1 RNA levels were normalized to total RNA, as measured by RIBOGREEN®. Results are presented as percent change of MALAT1 RNA, relative to PBS control.

The half maximal inhibitory concentration (IC$_{50}$) of each modified oligonucleotide was calculated using a linear regression on a log/linear plot of the data in excel and is also presented in the tables below. The % UTC values for modified oligonucleotides marked with a triple asterisk in the tables below has been previously presented in Example 3 (Table 3) herein above. The % UTC and IC$_{50}$ data for modified oligonucleotides marked with a triple asterisk (***) in the tables below is identical to the data presented in Example 3 as the data is from the same experiments.

TABLE 68

Dose-dependent percent reduction of human MALAT1 RNA in A431 cells by modified oligonucleotides

| Compound Number | MALAT1 (% UTC) | | | | | |
|---|---|---|---|---|---|---|
| | 0.4 nM | 2 nM | 10 nM | 50 nM | 250 nM | IC$_{50}$ nM |
| 395240 | 177 | 217 | 122 | 22 | 4 | 57 |
| 395243 | 117 | 65 | 74 | 86 | 23 | 92 |
| 395244 | 93 | 103 | 74 | 37 | 9 | 25 |
| 395248 | 106 | 110 | 95 | 44 | 17 | 50 |
| 395253 | 103 | 90 | 79 | 20 | 8 | 19 |
| 395254 | 97 | 85 | 57 | 16 | 6 | 12 |
| 395255 | 67 | 84 | 81 | 60 | 29 | 98 |
| 395256 | 110 | 93 | 85 | 26 | 7 | 23 |
| 395280 | 80 | 77 | 73 | 46 | 21 | 28 |
| 556089 | 112 | 79 | 103 | 40 | 19 | 44 |
| 559497 | 90 | 94 | 75 | 40 | 11 | 25 |
| 559590 | 116 | 118 | 82 | 34 | 8 | 32 |

TABLE 69

Dose-dependent percent reduction of human MALAT1 RNA in A431 cells by modified oligonucleotides

| Compound Number | MALAT1 (% UTC) | | | | | |
|---|---|---|---|---|---|---|
| | 0.4 nM | 2 nM | 10 nM | 50 nM | 250 nM | IC$_{50}$ nM |
| 395240 | 93 | 77 | 46 | 19 | 10 | 9 |
| 395253 | 89 | 74 | 31 | 8 | 6 | 6 |
| 395254 | 84 | 59 | 23 | 11 | 7 | 3 |
| 395256 | 87 | 77 | 48 | 24 | 7 | 9 |
| 556089 | 101 | 85 | 71 | 34 | 14 | 22 |
| 559497 | 92 | 84 | 64 | 33 | 12 | 17 |
| 559564 | 85 | 67 | 30 | 8 | 2 | 4 |

TABLE 69-continued

Dose-dependent percent reduction of human MALAT1 RNA in A431 cells by modified oligonucleotides

| Compound Number | MALAT1 (% UTC) | | | | | |
|---|---|---|---|---|---|---|
| | 0.4 nM | 2 nM | 10 nM | 50 nM | 250 nM | $IC_{50}$ nM |
| 1157124 | 99 | 69 | 31 | 8 | 3 | 6 |
| 1157190 | 71 | 28 | 13 | 4 | 2 | 1 |
| 1157958 | 85 | 47 | 15 | 3 | 1 | 2 |
| 1157992 | 67 | 24 | 6 | 2 | 1 | 0.4 |
| 1158618 | 76 | 60 | 22 | 5 | 3 | 3 |

Example 17: Dose-Dependent Inhibition of Human MALAT1 in A431 Cells by 3-10-3 cEt Gapmers Certain modified oligonucleotides described in the studies above exhibiting significant in vitro inhibition of MALAT1 RNA were selected and tested at various doses in A431 cells.

The modified oligonucleotides were tested in a series of experiments using the same culture conditions. The results for each experiment are presented in separate tables shown below. Cultured A431 cells at a density of 10,000 cells per well were transfected using free uptake with modified oligonucleotides diluted to different concentrations as specified in the tables below. After a treatment period of approximately 48 hours, RNA levels were measured as previously described using the Human primer-probe set RTS2736. MALAT1 RNA levels were normalized to total RNA, as measured by RIBOGREEN®. Results are presented as percent change of MALAT1 RNA, relative to PBS control.

The half maximal inhibitory concentration ($IC_{50}$) of each modified oligonucleotide was calculated using a linear regression on a log/linear plot of the data in excel and is also presented in the tables below. The % UTC values for modified oligonucleotides marked with a triple asterisk in the tables below has been previously presented in Example 3 (Table 3) herein above. The % UTC and $IC_{50}$ data for modified oligonucleotides marked with a triple asterisk (✱) in the tables below is identical to the data presented in Example 3 as the data is from the same experiments.

TABLE 70

Dose-dependent percent reduction of human MALAT1 RNA in A431 cells by modified oligonucleotides

| Compound Number | MALAT1 (% UTC) | | | | |
|---|---|---|---|---|---|
| | 0.3 nM | 1 nM | 5 nM | 20 nM | $IC_{50}$ nM |
| 559564 | 112 | 96 | 74 | 30 | 11 |
| 1156957 | 91 | 75 | 50 | 20 | 4 |
| 1157124 | 99 | 89 | 82 | 25 | 11 |
| 1157190 ✱ | 89 | 93 | 58 | 18 | 6 |
| 1157191 | 140 | 99 | 69 | 29 | 9 |
| 1157224 | 102 | 110 | 88 | 35 | 20 |
| 1157525 | 102 | 94 | 92 | 46 | >20 |
| 1157826 | 137 | 113 | 101 | 86 | >20 |
| 1157924 | 96 | 89 | 66 | 26 | 8 |
| 1157925 | 88 | 96 | 68 | 28 | 9 |
| 1157958 | 114 | 88 | 58 | 20 | 6 |
| 1157959 | 97 | 60 | 49 | 14 | 3 |
| 1157992 | 70 | 86 | 44 | 12 | 3 |
| 1157993 | 87 | 78 | 43 | 12 | 3 |
| 1158157 | 97 | 62 | 72 | 33 | 8 |
| 1158618 | 95 | 89 | 43 | 21 | 5 |
| 1158652 | 107 | 106 | 73 | 33 | 13 |
| 1158820 | 92 | 93 | 62 | 25 | 7 |
| 1158886 | 106 | 98 | 77 | 29 | 12 |

TABLE 71

Dose-dependent percent reduction of human MALAT1 RNA in A431 cells by modified oligonucleotides

| Compound Number | MALAT1 (% UTC) | | | | |
|---|---|---|---|---|---|
| | 0.3 nM | 1 nM | 5 nM | 20 nM | $IC_{50}$ nM |
| 559564 | 170 | 98 | 54 | 16 | 6 |
| 1156959 | 78 | 71 | 35 | 9 | 2 |
| 1156960 | 165 | 118 | 59 | 22 | 8 |
| 1156993 | 88 | 101 | 79 | 26 | 12 |
| 1157092 | 118 | 112 | 62 | 24 | 8 |
| 1157093 | 91 | 78 | 55 | 15 | 4 |
| 1157127 | 102 | 94 | 72 | 23 | 9 |
| 1157926 | 93 | 87 | 59 | 20 | 6 |
| 1157960 | 94 | 84 | 47 | 17 | 4 |
| 1157994 | 92 | 63 | 45 | 11 | 3 |
| 1158158 | 85 | 71 | 31 | 6 | 2 |
| 1158159 | 95 | 75 | 30 | 5 | 3 |
| 1158359 | 96 | 98 | 68 | 30 | 10 |
| 1158490 | 98 | 102 | 62 | 26 | 8 |
| 1158491 | 95 | 70 | 33 | 6 | 3 |
| 1158492 | 84 | 52 | 14 | 3 | 1 |
| 1158622 | 144 | 129 | 70 | 22 | 10 |
| 1158821 | 98 | 76 | 50 | 15 | 4 |
| 1158855 | 123 | 129 | 104 | 38 | >20 |

TABLE 72

Dose-dependent percent reduction of human MALAT1 RNA in A431 cells by modified oligonucleotides

| Compound Number | MALAT1 (% UTC) | | | | |
|---|---|---|---|---|---|
| | 0.3 nM | 1 nM | 5 nM | 20 nM | $IC_{50}$ nM |
| 559564 | 145 | 123 | 63 | 23 | 9 |
| 1157095 | 114 | 101 | 78 | 27 | 11 |
| 1157128 | 96 | 130 | 83 | 37 | >20 |
| 1157130 | 101 | 90 | 63 | 18 | 6 |
| 1157431 | 82 | 66 | 63 | 46 | 14 |
| 1157597 | 121 | 84 | 58 | 16 | 6 |
| 1157831 | 94 | 90 | 67 | 28 | 9 |
| 1157895 | 102 | 113 | 88 | 56 | >20 |
| 1157928 | 104 | 106 | 76 | 33 | 13 |
| 1157929 ✱ | 81 | 76 | 29 | 10 | 2 |
| 1158161 ✱ | 83 | 77 | 37 | 9 | 3 |
| 1158162 ✱ | 82 | 78 | 32 | 10 | 3 |
| 1158227 | 83 | 86 | 61 | 24 | 6 |
| 1158228 | 106 | 91 | 56 | 25 | 7 |
| 1158429 | 144 | 101 | 60 | 29 | 8 |
| 1158459 | 113 | 114 | 104 | 52 | >20 |
| 1158623 | 79 | 82 | 56 | 24 | 5 |
| 1158789 | 107 | 121 | 98 | 43 | >20 |
| 1158857 | 105 | 107 | 60 | 23 | 8 |

TABLE 73

Dose-dependent percent reduction of human MALAT1
RNA in A431 cells by modified oligonucleotides

| Compound Number | MALAT1 (% UTC) | | | | IC$_{50}$ nM |
|---|---|---|---|---|---|
| | 0.3 nM | 1 nM | 5 nM | 20 nM | |
| 559564 | 151 | 92 | 57 | 19 | 6 |
| 1156996 | 96 | 87 | 51 | 24 | 6 |
| 1157096 | 107 | 112 | 66 | 45 | 18 |
| 1157097 | 79 | 70 | 39 | 9 | 2 |
| 1157131 | 59 | 67 | 36 | 10 | 1 |
| 1157366 | 87 | 82 | 39 | 10 | 3 |
| 1157697 | 73 | 80 | 51 | 19 | 4 |
| 1157698 | 71 | 41 | 36 | 13 | 1 |
| 1157897 | 98 | 102 | 66 | 29 | 10 |
| 1157931 | 101 | 84 | 47 | 13 | 4 |
| 1158000 | 146 | 83 | 74 | 25 | 8 |
| 1158163 | 103 | 84 | 41 | 12 | 4 |
| 1158164 | 97 | 81 | 45 | 11 | 4 |
| 1158230 | 78 | 62 | 31 | 10 | 2 |
| 1158231 | 115 | 82 | 53 | 21 | 5 |
| 1158263 | 102 | 99 | 68 | 28 | 9 |
| 1158495 | 104 | 90 | 42 | 12 | 4 |
| 1158625 | 80 | 68 | 48 | 21 | 3 |
| 1158859 | 99 | 96 | 58 | 18 | 6 |

TABLE 74

Dose-dependent percent reduction of human MALAT1
RNA in A431 cells by modified oligonucleotides

| Compound Number | MALAT1 (% UTC) | | | | IC$_{50}$ nM |
|---|---|---|---|---|---|
| | 0.3 nM | 1 nM | 5 nM | 20 nM | |
| 559564 | 115 | 91 | 44 | 14 | 5 |
| 1157032 | 86 | 103 | 35 | 8 | 5 |
| 1157033 | 93 | 67 | 43 | 27 | 4 |
| 1157064 | 86 | 75 | 43 | 16 | 3 |
| 1157065 | 93 | 75 | 56 | 21 | 5 |
| 1157099 | 89 | 78 | 55 | 25 | 5 |
| 1157534 | 79 | 75 | 62 | 36 | 9 |
| 1157535 | 105 | 90 | 45 | 19 | 5 |
| 1157600 | 93 | 100 | 45 | 14 | 5 |
| 1157701 | 102 | 96 | 61 | 18 | 6 |
| 1157898 | 89 | 88 | 59 | 23 | 6 |
| 1158001 | 85 | 106 | 74 | 35 | 12 |
| 1158002 | 90 | 73 | 34 | 10 | 3 |
| 1158067 | 88 | 79 | 54 | 23 | 5 |
| 1158165 | 93 | 68 | 27 | 7 | 2 |
| 1158232 | 79 | 80 | 61 | 21 | 5 |
| 1158431 | 107 | 89 | 74 | 32 | 11 |
| 1158497 | 94 | 95 | 56 | 20 | 6 |
| 1158626 | 79 | 86 | 56 | 36 | 9 |

TABLE 75

Dose-dependent percent reduction of human MALAT1
RNA in A431 cells by modified oligonucleotides

| Compound Number | MALAT1 (% UTC) | | | | IC$_{50}$ nM |
|---|---|---|---|---|---|
| | 0.3 nM | 1 nM | 5 nM | 20 nM | |
| 559564 | 143 | 83 | 48 | 15 | 5 |
| 1157001 | 100 | 76 | 36 | 8 | 3 |
| 1157034 | 72 | 57 | 26 | 6 | 1 |
| 1157035 | 115 | 89 | 46 | 11 | 4 |
| 1157101 | 95 | 83 | 48 | 13 | 4 |
| 1157102 | 113 | 65 | 25 | 8 | 3 |
| 1157836 | 95 | 83 | 56 | 28 | 6 |
| 1157900 | 105 | 93 | 51 | 19 | 5 |
| 1157901 | 56 | 83 | 62 | 16 | 6 |
| 1157902 | 109 | 86 | 34 | 13 | 4 |

TABLE 75-continued

Dose-dependent percent reduction of human MALAT1
RNA in A431 cells by modified oligonucleotides

| Compound Number | MALAT1 (% UTC) | | | | IC$_{50}$ nM |
|---|---|---|---|---|---|
| | 0.3 nM | 1 nM | 5 nM | 20 nM | |
| 1157934 | 108 | 80 | 46 | 11 | 4 |
| 1157936 | 91 | 59 | 24 | 5 | 2 |
| 1157969 | 119 | 96 | 53 | 17 | 6 |
| 1157970 | 89 | 60 | 19 | 5 | 2 |
| 1158003 | 89 | 82 | 43 | 10 | 3 |
| 1158004 | 90 | 62 | 30 | 7 | 2 |
| 1158069 | 88 | 78 | 47 | 19 | 4 |
| 1158167 | 95 | 88 | 51 | 15 | 5 |
| 1158168 | 84 | 63 | 33 | 9 | 2 |

TABLE 76

Dose-dependent percent reduction of human MALAT1
RNA in A431 cells by modified oligonucleotides

| Compound Number | MALAT1 (% UTC) | | | | IC$_{50}$ nM |
|---|---|---|---|---|---|
| | 0.3 nM | 1 nM | 5 nM | 20 nM | |
| 559564 | 135 | 84 | 58 | 17 | 6 |
| 946404 | 107 | 73 | 44 | 12 | 4 |
| 1157036 | 99 | 76 | 42 | 21 | 4 |
| 1157103 | 95 | 86 | 56 | 30 | 7 |
| 1157171 | 129 | 89 | 41 | 11 | 5 |
| 1157571 | 128 | 101 | 80 | 24 | 10 |
| 1157703 | 91 | 84 | 50 | 23 | 5 |
| 1157871 | 94 | 87 | 48 | 17 | 5 |
| 1157938 | 95 | 69 | 38 | 11 | 3 |
| 1157971 | 83 | 60 | 16 | 5 | 2 |
| 1157972 | 93 | 71 | 22 | 7 | 2 |
| 1158005 | 98 | 68 | 24 | 7 | 2 |
| 1158135 | 88 | 91 | 63 | 29 | 8 |
| 1158136 | 63 | 80 | 46 | 19 | 5 |
| 1158137 | 85 | 67 | 28 | 9 | 2 |
| 1158170 | 87 | 72 | 33 | 10 | 3 |
| 1158236 | 99 | 102 | 78 | 34 | 12 |
| 1158435 | 120 | 91 | 59 | 25 | 7 |
| 1158631 | 99 | 112 | 81 | 70 | >20 |

TABLE 77

Dose-dependent percent reduction of human MALAT1
RNA in A431 cells by modified oligonucleotides

| Compound Number | MALAT1 (% UTC) | | | | IC$_{50}$ nM |
|---|---|---|---|---|---|
| | 0.3 nM | 1 nM | 5 nM | 20 nM | |
| 559564 | 129 | 95 | 55 | 18 | 6 |
| 1157139 | 89 | 69 | 44 | 14 | 3 |
| 1157306 | 104 | 61 | 63 | 17 | 5 |
| 1157474 | 148 | 129 | 78 | 28 | 11 |
| 1157575 | 102 | 61 | 29 | 9 | 3 |
| 1157807 | 85 | 77 | 77 | 31 | 11 |
| 1157872 | 117 | 104 | 57 | 20 | 7 |
| 1157905 | 117 | 91 | 47 | 22 | 6 |
| 1157940 | 121 | 88 | 43 | 12 | 5 |
| 1157973 | 108 | 87 | 34 | 7 | 4 |
| 1157974 | 128 | 106 | 47 | 12 | 6 |
| 1158006 | 94 | 77 | 44 | 16 | 4 |
| 1158138 | 91 | 80 | 44 | 14 | 4 |
| 1158139 | 93 | 66 | 25 | 7 | 2 |
| 1158171 | 102 | 81 | 28 | 8 | 3 |
| 1158172 | 95 | 72 | 38 | 12 | 3 |
| 1158337 | 97 | 84 | 43 | 14 | 4 |
| 1158338 | 96 | 92 | 57 | 17 | 5 |
| 1158568 | 117 | 77 | 47 | 18 | 5 |

TABLE 78

Dose-dependent percent reduction of human MALAT1 RNA in A431 cells by modified oligonucleotides

| Compound Number | MALAT1 (% UTC) | | | | IC$_{50}$ nM |
|---|---|---|---|---|---|
| | 0.3 nM | 1 nM | 5 nM | 20 nM | |
| 559564 | 132 | 103 | 68 | 22 | 8 |
| 1157009 | 151 | 100 | 54 | 23 | 7 |
| 1157108 | 114 | 74 | 30 | 9 | 3 |
| 1157109 | 137 | 78 | 52 | 16 | 5 |
| 1157142 | 111 | 96 | 88 | 28 | 13 |
| 1157150 | 107 | 100 | 74 | 35 | 13 |
| 1157207 | 129 | 102 | 65 | 22 | 8 |
| 1157750 | 122 | 113 | 92 | 58 | >20 |
| 1157841 | 111 | 93 | 68 | 43 | 14 |
| 1157941 | 102 | 85 | 44 | 17 | 4 |
| 1157942 | 113 | 96 | 72 | 19 | 8 |
| 1157943 | 142 | 102 | 67 | 20 | 8 |
| 1158140 | 89 | 68 | 31 | 12 | 2 |
| 1158141 | 100 | 97 | 16 | 28 | 4 |
| 1158373 | 108 | 105 | 79 | 41 | 19 |
| 1158569 | 123 | 84 | 44 | 15 | 5 |
| 1158570 | 96 | 82 | 58 | 18 | 5 |
| 1158736 | 111 | 97 | 79 | 39 | 16 |
| 1158737 | 135 | 113 | 76 | 43 | 15 |

TABLE 79

Dose-dependent percent reduction of human MALAT1 RNA in A431 cells by modified oligonucleotides

| Compound Number | MALAT1 (% UTC) | | | | IC$_{50}$ nM |
|---|---|---|---|---|---|
| | 0.3 nM | 1 nM | 5 nM | 20 nM | |
| 559564 | 138 | 125 | 74 | 32 | 12 |
| 1156942 | 108 | 91 | 71 | 30 | 10 |
| 1157042 | 93 | 102 | 93 | 72 | 20 |
| 1157044 | 116 | 93 | 64 | 19 | 7 |
| 1157075 | 85 | 87 | 64 | 28 | 8 |
| 1157076 | 134 | 113 | 80 | 32 | 12 |
| 1157077 | 103 | 102 | 82 | 26 | 10 |
| 1157110 | 107 | 93 | 50 | 13 | 5 |
| 1157111 ** | 108 | 73 | 6 | 7 | 2 |
| 1157279 | 127 | 111 | 99 | 74 | >20 |
| 1157478 | 134 | 114 | 74 | 13 | 8 |
| 1157546 | 200 | 149 | 107 | 40 | 17 |
| 1157644 | 90 | 94 | 60 | 24 | 7 |
| 1157711 | 74 | 109 | 75 | 32 | 11 |
| 1157712 | 128 | 93 | 51 | 19 | 6 |
| 1158012 | 111 | 101 | 90 | 44 | 27 |
| 1158142 | 113 | 111 | 75 | 23 | 10 |
| 1158175 | 105 | 112 | 109 | 130 | 20 |
| 1158738 | 98 | 92 | 72 | 30 | 10 |

TABLE 80

Dose-dependent percent reduction of human MALAT1 RNA in A431 cells by modified oligonucleotides

| Compound Number | MALAT1 (% UTC) | | | | IC$_{50}$ nM |
|---|---|---|---|---|---|
| | 0.3 nM | 1 nM | 5 nM | 20 nM | |
| 559564 | 127 | 129 | 73 | 27 | 10 |
| 1156978 | 112 | 106 | 71 | 45 | 17 |
| 1157179 | 104 | 93 | 65 | 36 | 10 |
| 1157180 | 95 | 94 | 60 | 31 | 9 |
| 1157181 | 124 | 78 | 45 | 13 | 4 |
| 1157246 | 93 | 91 | 72 | 32 | 11 |
| 1157247 | 104 | 107 | 78 | 42 | 20 |
| 1157282 | 128 | 98 | 62 | 25 | 8 |
| 1157448 | 96 | 92 | 20 | 23 | 4 |
| 1157612 | 96 | 99 | 57 | 43 | 12 |
| 1157780 | 97 | 110 | 81 | 34 | 12 |
| 1157880 | 102 | 100 | 69 | 41 | 15 |
| 1157912 | 87 | 92 | 52 | 19 | 5 |
| 1157946 | 112 | 97 | 68 | 37 | 11 |
| 1157947 | 93 | 91 | 50 | 15 | 5 |
| 1158013 | 95 | 104 | 97 | 56 | >20 |
| 1158312 | 96 | 99 | 77 | 33 | 13 |
| 1158541 | 102 | 96 | 68 | 43 | 16 |
| 1158839 | 95 | 81 | 82 | 44 | >20 |

TABLE 81

Dose-dependent percent reduction of human MALAT1 RNA in A431 cells by modified oligonucleotides

| Compound Number | MALAT1 (% UTC) | | | | IC$_{50}$ nM |
|---|---|---|---|---|---|
| | 0.3 nM | 1 nM | 5 nM | 20 nM | |
| 559564 | 145 | 127 | 69 | 22 | 9 |
| 1157014 | 99 | 83 | 62 | 23 | 6 |
| 1157016 | 85 | 70 | 39 | 10 | 3 |
| 1157048 | 99 | 73 | 12 | 11 | 2 |
| 1157080 | 90 | 76 | 47 | 15 | 4 |
| 1157081 | 88 | 78 | 43 | 13 | 3 |
| 1157251 | 115 | 78 | 51 | 16 | 5 |
| 1157450 | 100 | 82 | 43 | 16 | 4 |
| 1157718 | 131 | 90 | 54 | 15 | 6 |
| 1157782 | 98 | 79 | 46 | 14 | 4 |
| 1157915 | 95 | 101 | 49 | 15 | 6 |
| 1157948 | 110 | 92 | 60 | 18 | 6 |
| 1157951 | 102 | 74 | 29 | 8 | 3 |
| 1157982 | 83 | 78 | 37 | 15 | 3 |
| 1157983 | 87 | 80 | 41 | 8 | 3 |
| 1158381 | 113 | 88 | 74 | 35 | 11 |
| 1158809 | 87 | 92 | 46 | 11 | 4 |
| 1158810 | 90 | 53 | 20 | 5 | 2 |
| 1158812 | 86 | 49 | 13 | 3 | 1 |

TABLE 82

Dose-dependent percent reduction of human MALAT1 RNA in A431 cells by modified oligonucleotides

| Compound Number | MALAT1 (% UTC) | | | | IC$_{50}$ nM |
|---|---|---|---|---|---|
| | 0.3 nM | 1 nM | 5 nM | 20 nM | |
| 559564 | 129 | 101 | 66 | 25 | 8 |
| 568503 | 95 | 78 | 21 | 21 | 3 |
| 1156951 | 94 | 84 | 47 | 14 | 4 |
| 1157153 | 102 | 91 | 64 | 25 | 7 |
| 1157185 | 156 | 109 | 65 | 23 | 8 |
| 1157186 | 85 | 83 | 44 | 15 | 4 |
| 1157318 | 96 | 97 | 73 | 41 | 18 |
| 1157454 | 81 | 81 | 36 | 11 | 3 |
| 1157519 | 105 | 101 | 75 | 36 | 14 |
| 1157752 | 110 | 61 | 39 | 12 | 3 |
| 1157886 | 95 | 101 | 48 | 15 | 6 |
| 1157919 | 95 | 89 | 34 | 10 | 3 |
| 1157953 | 109 | 94 | 46 | 13 | 5 |
| 1157987 | 93 | 82 | 38 | 12 | 3 |
| 1158051 | 113 | 120 | 137 | 81 | 20 |
| 1158084 | 112 | 93 | 60 | 30 | 8 |
| 1158183 | 90 | 84 | 51 | 20 | 5 |
| 1158645 | 107 | 98 | 49 | 22 | 6 |
| 1158814 | 98 | 88 | 66 | 23 | 7 |

TABLE 83

Dose-dependent percent reduction of human MALAT1 RNA in A431 cells by modified oligonucleotides

| Compound Number | MALAT1 (% UTC) | | | | IC$_{50}$ nM |
|---|---|---|---|---|---|
| | 0.3 nM | 1 nM | 5 nM | 20 nM | |
| 559564 | 142 | 106 | 57 | 17 | 7 |
| 1156950 | 97 | 78 | 47 | 15 | 4 |
| 1157015 | 94 | 80 | 37 | 11 | 3 |
| 1157017 | 89 | 75 | 43 | 11 | 4 |
| 1157084 | 82 | 86 | 51 | 12 | 3 |
| 1157518 | 74 | 71 | 29 | 9 | 4 |
| 1157717 | 87 | 66 | 27 | 9 | 7 |
| 1157754 | 99 | 82 | 54 | 19 | 7 |
| 1157783 | 95 | 83 | 58 | 12 | 2 |
| 1157918 | 96 | 76 | 40 | 9 | 3 |
| 1157920 | 131 | 79 | 41 | 11 | 3 |
| 1157950 | 94 | 78 | 10 | 8 | 2 |
| 1157984 | 50 | 59 | 28 | 4 | 2 |
| 1158021 | 174 | 131 | 60 | 19 | 2 |
| 1158150 | 85 | 82 | 53 | 14 | 5 |
| 1158614 | 82 | 45 | 16 | 3 | 1 |
| 1158780 | 85 | 99 | 67 | 19 | 5 |
| 1158811 | 105 | 65 | 40 | 8 | 4 |
| 1158813 | 100 | 110 | 67 | 12 | 8 |

TABLE 84

Dose-dependent percent reduction of human MALAT1 RNA in A431 cells by modified oligonucleotides

| Compound Number | MALAT1 (% UTC) | | | | IC$_{50}$ nM |
|---|---|---|---|---|---|
| | 0.3 nM | 1 nM | 5 nM | 20 nM | |
| 559564 | 179 | 119 | 67 | 17 | 8 |
| 1156954 | 93 | 85 | 59 | 25 | 6 |
| 1156987 | 118 | 80 | 39 | 7 | 4 |
| 1156988 | 113 | 81 | 52 | 17 | 5 |
| 1157021 | 106 | 86 | 17 | 24 | 4 |
| 1157188 | 106 | 93 | 58 | 28 | 8 |
| 1157290 | 115 | 81 | 71 | 27 | 8 |
| 1157489 | 100 | 88 | 35 | 6 | 3 |
| 1157922 | 91 | 90 | 63 | 19 | 7 |
| 1157954 | 98 | 82 | 48 | 18 | 5 |
| 1158055 | 103 | 85 | 43 | 10 | 4 |
| 1158056 | 91 | 80 | 57 | 24 | 6 |
| 1158186 | 77 | 82 | 57 | 22 | 6 |
| 1158187 | 98 | 84 | 45 | 12 | 4 |
| 1158285 | 90 | 73 | 57 | 24 | 5 |
| 1158386 | 119 | 92 | 56 | 13 | 6 |
| 1158388 | 134 | 137 | 87 | 29 | 12 |
| 1158615 | 93 | 43 | 8 | 1 | 1 |
| 1158616 | 93 | 83 | 49 | 17 | 4 |

TABLE 85

Dose-dependent percent reduction of human MALAT1 RNA in A431 cells by modified oligonucleotides

| Compound Number | MALAT1 (% UTC) | | | | IC$_{50}$ nM |
|---|---|---|---|---|---|
| | 0.3 nM | 1 nM | 5 nM | 20 nM | |
| 395254 | 112 | 67 | 73 | 35 | 10 |
| 559564 | 146 | 119 | 84 | 30 | 12 |
| 1156481 | 109 | 103 | 87 | 87 | 20 |
| 1156989 | 83 | 85 | 59 | 25 | 7 |
| 1157123 | 128 | 112 | 58 | 32 | 9 |
| 1157223 | 99 | 88 | 54 | 24 | 6 |
| 1157357 | 95 | 95 | 70 | 82 | 20 |
| 1157524 | 105 | 103 | 52 | 15 | 6 |
| 1157726 | 106 | 86 | 69 | 36 | 11 |
| 1157756 | 102 | 86 | 86 | 45 | >20 |
| 1157923 | 89 | 83 | 24 | 18 | 3 |
| 1157957 | 82 | 96 | 38 | 17 | 5 |
| 1157991 | 88 | 80 | 25 | 4 | 2 |
| 1158090 | 128 | 118 | 115 | 59 | 20 |
| 1158255 | 90 | 84 | 74 | 26 | 9 |
| 1158487 | 115 | 91 | 74 | 22 | 8 |
| 1158585 | 62 | 78 | 47 | 17 | 4 |
| 1158717 | 80 | 97 | 80 | 66 | 20 |
| 1158851 | 89 | 84 | 95 | 83 | 20 |

Example 18: Dose-Dependent Inhibition of Human MALAT1 in MDA-MB-436 Cells by cEt Gapmers Modified oligonucleotides described in the studies above were tested at various doses in MDA-MB-436 cells. Cultured MDA-MB-436 cells at a density of 5,000-12,000 cells per well were treated using free uptake with modified oligonucleotides diluted to concentrations described in the tables below. After approximately 48 hours, MALAT1 RNA levels were measured as previously described using the Human MALAT1 primer-probe set RTS2736. MALAT1 RNA levels were normalized to b-actin, measured using human primer-probe set HTS5002 (described herein above). Results are presented in the tables below as percent control of the amount of MALAT1 RNA relative to untreated control cells (% UTC). IC50s were calculated using the "log(inhibitor) vs. response—variable slope (4 parameters)" formula using Prism6 software. The % UTC values for modified oligonucleotides marked with a triple asterisk in the tables below has been previously presented in Example 4 (Table 4) herein above. The % UTC data for modified oligonucleotides marked with a triple asterisk (***) in the tables below is identical to the data presented in Table 4 as the data is from the same experiments.

TABLE 86

Dose-dependent inhibition of human MALAT1 RNA expression by modified oligonucleotides in MDA-MB-436 cells

| Compound Number | % control | | | | IC50 (nM) |
|---|---|---|---|---|---|
| | 0.8 nM | 4.0 nM | 20.0 nM | 100.0 nM | |
| 559564 | 105 | 93 | 54 | 12 | 22.9 |
| 568503 | 90 | 76 | 34 | 20 | 12.2 |
| 1157044 | 138 | 84 | 51 | 20 | 22.9 |
| 1157131 | 102 | 52 | 47 | 6 | 9.6 |
| 1157150 | 92 | 80 | 53 | 27 | 25.0 |
| 1157190 *** | 56 | 39 | 15 | 5 | 1.4 |
| 1157726 | 82 | 58 | 53 | 14 | 11.1 |
| 1157929 *** | 58 | 51 | 33 | 5 | 2.6 |
| 1157936 | 34 | 30 | 18 | 6 | 0.2 |
| 1157943 | 64 | 49 | 39 | 10 | 3.6 |
| 1157958 | 50 | 32 | 21 | 6 | 0.9 |
| 1157959 | 83 | 52 | 27 | 5 | 4.9 |
| 1157992 | 51 | 44 | 9 | 2 | 1.2 |
| 1157993 | 67 | 28 | 14 | 3 | 1.6 |
| 1158002 | 49 | 62 | 49 | 12 | 3.7 |
| 1158005 | 49 | 34 | 17 | 3 | 0.8 |
| 1158161 *** | 36 | 48 | 27 | 3 | 0.5 |
| 1158230 | 65 | 57 | 63 | 12 | 8.9 |
| 1158263 | 61 | 59 | 52 | 29 | 9.3 |
| 1158490 | 78 | 54 | 32 | 15 | 5.7 |
| 1158491 | 58 | 40 | 20 | 9 | 1.6 |
| 1156959 | 68 | 55 | 33 | 6 | 4.2 |

TABLE 86-continued

Dose-dependent inhibition of human MALAT1 RNA expression by modified oligonucleotides in MDA-MB-436 cells

| Compound Number | % control | | | | IC50 (nM) |
|---|---|---|---|---|---|
| | 0.8 nM | 4.0 nM | 20.0 nM | 100.0 nM | |
| 1158618 | 56 | 55 | 28 | 9 | 2.6 |
| 1158821 | 50 | 53 | 28 | 8 | 1.8 |
| 1158886 | 58 | 57 | 53 | 21 | 6.4 |
| 1157021 | 70 | 46 | 50 | 19 | 5.8 |
| 1157032 | 94 | 51 | 20 | 3 | 4.8 |
| 1157034 * | 50 | 25 | 17 | 5 | 0.7 |
| 1157048 | 57 | 41 | 28 | 9 | 1.7 |
| 1157097 | 56 | 63 | 27 | 4 | 3.2 |
| 1157108 | 51 | 37 | 18 | 3 | 1.0 |
| 1157110 | 51 | 48 | 17 | 5 | 1.4 |
| 1157111 * | 98 | 30 | 13 | 8 | 2.9 |
| 1157181 | 104 | 56 | 30 | 7 | 7.0 |
| 1157448 | 77 | 89 | 43 | 17 | 16.8 |
| 1157575 | 101 | 64 | 21 | 6 | 6.8 |
| 1157698 | 99 | 81 | 51 | 16 | 20.0 |
| 1157752 | 77 | 89 | 49 | 11 | 18.2 |
| 1157912 | 43 | 61 | 32 | 12 | 1.6 |
| 1157919 | 84 | 38 | 32 | 5 | 3.8 |
| 1157923 | 72 | 53 | 34 | 8 | 4.6 |
| 1157947 | 90 | 61 | 27 | 6 | 6.6 |
| 1157950 | 108 | 104 | 48 | 12 | 20.2 |
| 1157951 | 106 | 85 | 33 | 6 | 12.8 |
| 1157970 | 59 | 58 | 24 | 4 | 3.0 |
| 1157971 | 57 | 40 | 19 | 4 | 1.5 |
| 1157972 | 91 | 34 | 10 | 3 | 2.8 |
| 1157973 | 71 | 55 | 11 | 2 | 3.3 |
| 1157974 | 83 | 72 | 24 | 5 | 7.7 |
| 1157984 | 80 | 74 | 52 | 13 | 15.1 |
| 1157991 | 67 | 65 | 19 | 2 | 4.3 |
| 1158004 | 68 | 57 | 26 | 3 | 4.0 |
| 1158056 | 52 | 99 | 67 | 23 | 34.9 |
| 1158137 | 65 | 37 | 35 | 4 | 2.3 |
| 1158139 | 62 | 59 | 35 | 10 | 4.4 |
| 1158140 | 59 | 67 | 38 | 10 | 5.4 |
| 1158159 | 112 | 85 | 27 | 10 | 11.6 |
| 1158162 * | 57 | 37 | 22 | 6 | 1.5 |
| 1158163 | 118 | 51 | 16 | 7 | 4.0 |
| 1158164 | 90 | 52 | 19 | 6 | 4.7 |
| 1158165 | 79 | 36 | 10 | 3 | 2.5 |
| 1158168 | 45 | 37 | 19 | 6 | 0.7 |
| 1158171 | 78 | 31 | 16 | 6 | 2.4 |
| 1158492 | 41 | 29 | 12 | 5 | 0.4 |
| 1158614 | 45 | 36 | 26 | 8 | 0.6 |
| 1158615 | 31 | 19 | 14 | 6 | 0.1 |
| 1158810 | 40 | 23 | 11 | 4 | 0.4 |
| 1158812 | 47 | 29 | 15 | 2 | 0.7 |

Example 19: Tolerability of Modified Oligonucleotides Targeting Human MALAT1 in CD-1 Mice BALB/c mice are a multipurpose mouse model frequently utilized for safety and efficacy testing. The mice were treated with modified oligonucleotides selected from studies described above and evaluated for changes in the levels of various plasma chemistry markers.

Study 1

Groups of four 6-to-8-week-old male BALB/c mice were injected subcutaneously twice a week for 4 weeks (for a total of 8 treatments) with 50 mg/kg of modified oligonucleotides. One group of four male CD-1 mice was injected with PBS. Mice were euthanized 24 hours following the final administration.

To evaluate the effect of modified oligonucleotides on liver and kidney function, plasma levels of aspartate aminotransferase (AST), alanine aminotransferase (ALT), total bilirubin (TBIL), and blood urea nitrogen (BUN) were measured using an automated clinical chemistry analyzer (Hitachi Olympus AU400c, Melville, N.Y.). The results are presented in the table below. Assays include four animals in a group, except where an asterisk (*) indicates that 3 animals or less was used for a specific assay. Modified oligonucleotides that caused changes in the levels of any of the liver or kidney function markers outside the expected range for modified oligonucleotides were excluded in further studies.

TABLE 87

Plasma chemistry markers in male BALB/c mice

| Compound Number | ALT (IU/L) | AST (IU/L) | BUN (mg/dL) |
|---|---|---|---|
| PBS | 126 | 112 | 23 |
| 556057 | 6377 | 4060 | 29 |
| 556089 | 120 | 127 | 19 |
| 559479 | 511 | 521 | 24 |
| 559482 | 65 | 89 | 25 |
| 559484 | 2728 | 1760 | 24 |
| 559497* | 43 | 72 | 28 |
| 559509 | 2535 | 2366 | 28 |
| 559511 | 2226 | 1626 | 25 |
| 559512 | 304 | 261 | 28 |
| 559519 | 912 | 470 | 24 |
| 559547 | 2213 | 839 | 32 |
| 559548 | 3279 | 1520 | 28 |
| 559551 | 374 | 215 | 21 |
| 559554 | 1921 | 1649 | 24 |
| 559564 | 88 | 116 | 24 |
| 559567 | 2832 | 5557 | 24 |
| 559581 | 1301 | 842 | 23 |
| 559585 | 1038 | 1053 | 25 |
| 559587 | 716 | 490 | 24 |
| 559588 | 2706 | 2201 | 18 |
| 559590* | 195 | 158 | 24 |
| 559596 | 51 | 114 | 24 |
| 559598 | 1301 | 999 | 25 |
| 559609* | 390 | 356 | 24 |

Body weight was measured on day 25, and the average body weight for each group is presented in the table below. Liver, kidney and spleen weights were measured at the end of the study and are presented in the table below. Modified oligonucleotides that caused any changes in organ weights outside the expected range for modified oligonucleotides were excluded from further studies.

TABLE 88

Body and organ weights (in grams)

| Compound Number | Body Weight (g) | Liver (g) | Kidney (g) | Spleen (g) |
|---|---|---|---|---|
| PBS | 25 | 1.3 | 0.4 | 0.1 |
| 556057 | 20 | 2.2 | 0.3 | 0.1 |
| 556089 | 25 | 1.7 | 0.4 | 0.1 |
| 559479 | 24 | 1.8 | 0.4 | 0.1 |
| 559482 | 26 | 1.5 | 0.4 | 0.2 |
| 559484 | 26 | 2.1 | 0.4 | 0.2 |
| 559497* | 24 | 1.3 | 0.4 | 0.1 |
| 559509 | 25 | 1.2 | 0.4 | 0.1 |
| 559511 | 22 | 1.4 | 0.3 | 0.1 |
| 559512 | 25 | 1.7 | 0.4 | 0.1 |
| 559519 | 24 | 1.8 | 0.3 | 0.1 |
| 559547 | 20 | 1 | 0.3 | 0.1 |
| 559548 | 25 | 3.4 | 0.3 | 0.2 |
| 559551 | 23 | 1.2 | 0.3 | 0.1 |
| 559554 | 27 | 2.2 | 0.4 | 0.2 |
| 559564 | 25 | 1.5 | 0.4 | 0.2 |
| 559567 | 17 | 1 | 0.3 | 0 |
| 559581 | 23 | 1.7 | 0.3 | 0.1 |
| 559585 | 24 | 1.6 | 0.4 | 0.1 |
| 559587 | 26 | 2.2 | 0.4 | 0.2 |
| 559588 | 22 | 1.4 | 0.3 | 0.2 |
| 559590* | 26 | 1.9 | 0.4 | 0.2 |

TABLE 88-continued

Body and organ weights (in grams)

| Compound Number | Body Weight (g) | Liver (g) | Kidney (g) | Spleen (g) |
|---|---|---|---|---|
| 559596 | 24 | 1.4 | 0.4 | 0.1 |
| 559598 | 25 | 1.9 | 0.4 | 0.1 |
| 559609 | 25 | 1.8 | 0.4 | 0.3 |

Study 2

Groups of four 4-to-6-week-old male CD-1 mice were injected subcutaneously twice a week for 4 weeks (for a total of 8 treatments) with 50 mg/kg/dose of modified oligonucleotides. One group of four male CD-1 mice was injected with PBS. Mice were euthanized 24 hours following the final administration. The values for modified oligonucleotides marked with a triple asterisk in the tables below have been previously presented in Tables 7 and 8 herein above. The data for modified oligonucleotides marked with a triple asterisk ($\ast\!\ast\!\ast$) in the tables below is identical to the data presented in Table 7 and Table 8 as the data is from the same experiments.

To evaluate the effect of modified oligonucleotides on liver and kidney function, plasma levels of alanine aminotransferase (ALT), aspartate aminotransferase (AST), blood urea nitrogen (BUN), total bilirubin (TBIL), and albumin (ALB) were measured using an automated clinical chemistry analyzer (Hitachi Olympus AU400c, Melville, N.Y.). The results are presented in the table below. Assays include four animals in a group, except where an asterisk (*) indicates that 3 animals or less was used for a specific assay. Modified oligonucleotides that caused changes in the levels of any of the liver or kidney function markers outside the expected range for modified oligonucleotides were excluded in further studies.

TABLE 89

Plasma chemistry markers in CD-1 Male mice

| Compound Number | ALT (IU/L) | AST (IU/L) | BUN (mg/dL) | TBIL (mg/dL) | ALB (g/dL) |
|---|---|---|---|---|---|
| PBS | 20 | 46 | 24 | 0.2 | 2.5 |
| 1157190 | 78 | 95 | 26 | 0.2 | 2.6 |
| 1157919 | 388 | 269 | 30 | 0.3 | 2.3 |
| 1157929 ✱ | 330 | 225 | 24 | 0.2 | 2.3 |
| 1157936 | 220 | 171 | 25 | 0.2 | 2.2 |
| 1157958 | 38 | 50 | 22 | 0.2 | 2.4 |
| 1157970 | 195 | 250 | 25 | 6.1 | 3.1 |
| 1157972 | 1172 | 824 | 23 | 2.9 | 2.9 |
| 1157991 | 343 | 264 | 25 | 0.2 | 2.2 |
| 1157992 | 1168 | 2608 | 18 | 1.9 | 2.5 |
| 1157993 | 630 | 545 | 23 | 0.2 | 1.9 |
| 1158002 | 963 | 737 | 26 | 0.2 | 2.2 |
| 1158005 | 115 | 149 | 25 | 0.2 | 1.9 |
| 1158161 ✱ | 86 | 128 | 29 | 0.2 | 2.3 |
| 1158162 | 178 | 199 | 25 | 0.2 | 2.5 |
| 1158491 | 598 | 684 | 24 | 0.2 | 2.2 |
| 1158492 | 451 | 417 | 20 | 0.2 | 1.9 |
| 1158810 | 1589* | 1409* | 37* | 0.3* | 2.3* |
| 1158812 | 4795* | 4273* | 30* | 1.4* | 4.5* |

Body weights of CD-1 mice were measured at the end of the study, and the average body weight for each group is presented in the table below. Liver, kidney and spleen weights were measured at the end of the study and are presented in the table below. Modified oligonucleotides that caused any changes in organ weights outside the expected range for modified oligonucleotides were excluded from further studies.

TABLE 90

Body and organ weights (in grams)

| Compound Number | Body Weight (g) | Liver (g) | Kidney (g) | Spleen (g) |
|---|---|---|---|---|
| PBS | 32 | 1.7 | 0.5 | 0.1 |
| 1157190 | 36 | 2.2 | 0.5 | 0.2 |
| 1157919 | 38 | 2.9 | 0.5 | 0.4 |
| 1157929 ✱ | 34 | 2.3 | 0.5 | 0.2 |
| 1157936 | 33 | 2 | 0.5 | 0.1 |
| 1157958 | 35 | 2.1 | 0.5 | 0.2 |
| 1157970 | 31 | 2.2 | 0.4 | 0.2 |
| 1157972 | 31 | 2.7 | 0.5 | 0.2 |
| 1157991 | 37 | 2.6 | 0.5 | 0.2 |
| 1157992 | 29 | 2.3 | 0.5 | 0.1 |
| 1157993 | 37 | 2.7 | 0.6 | 0.3 |
| 1158002 | 31 | 2.2 | 0.5 | 0.2 |
| 1158005 | 35 | 2.2 | 0.5 | 0.2 |
| 1158161 ✱ | 34 | 2.3 | 0.5 | 0.2 |
| 1158162 | 34 | 2.3 | 0.6 | 0.2 |
| 1158491 | 34 | 2.1 | 0.5 | 0.2 |
| 1158492 | 36 | 2.1 | 0.5 | 0.2 |
| 1158810 | 28 | 1.7 | 0.4 | 0.1 |
| 1158812 | 27 | 2 | 0.4 | 0.1 |

Study 3

Groups of four 4-to-6-week-old male CD-1 mice were injected subcutaneously twice a week for 4 weeks (for a total of 8 treatments) with 50 mg/kg/dose of modified oligonucleotides. One group of four male CD-1 mice was injected with PBS. Mice were euthanized 24 hours following the final administration.

To evaluate the effect of modified oligonucleotides on liver and kidney function, plasma levels of alanine aminotransferase (ALT), aspartate aminotransferase (AST), blood urea nitrogen (BUN), and total bilirubin (TBIL) were measured using an automated clinical chemistry analyzer (Hitachi Olympus AU400c, Melville, N.Y.). The results are presented in the table below. Assays include four animals in a group, except where an asterisk (*) indicates that 3 animals or less was used for a specific assay. Modified oligonucleotides that caused changes in the levels of any of the liver or kidney function markers outside the expected range for modified oligonucleotides were excluded in further studies.

The values for modified oligonucleotides marked with a triple asterisk in the tables below have been previously presented in Tables 13 and 14 herein above. The data for modified oligonucleotides marked with a triple asterisk ($\ast\!\ast\!\ast$) in the tables below is identical to the data presented in Table 13 and Table 14 as the data is from the same experiments

TABLE 91

Plasma chemistry markers in CD-1 Male mice

| ION NO. | ALT (IU/L) | AST (IU/L) | BUN (mg/dL) | TBIL (mg/dL) |
|---|---|---|---|---|
| PBS | 20 | 51 | 21 | 0.2 |
| 1157032 | 1933 | 746 | 20 | 0.1 |
| 1304893 | 52 | 106 | 19 | 0.2 |
| 1157919 | 389 | 271 | 30 | 0.2 |
| 1304889 | 57 | 80 | 25 | 0.2 |
| 1157936 | 86 | 87 | 18 | 0.2 |
| 1304906 ✱ | 59 | 78 | 22 | 0.2 |
| 1157970 | 224 | 305 | 21 | 0.2 |
| 1304890 ✱ | 33 | 51 | 21 | 0.2 |
| 1157972 | 1477 | 785 | 28 | 0.3 |
| 1304888 | 59 | 94 | 21 | 0.2 |
| 1157993 | 455 | 428 | 20 | 0.2 |
| 1304903 | 194 | 157 | 19 | 0.2 |
| 1158002 | 861 | 734 | 26 | 0.1 |
| 1304883 | 203 | 271 | 26 | 0.2 |
| 1158162 | 240 | 243 | 24 | 0.2 |

TABLE 91-continued

Plasma chemistry markers in CD-1 Male mice

| ION NO. | ALT (IU/L) | AST (IU/L) | BUN (mg/dL) | TBIL (mg/dL) |
|---|---|---|---|---|
| 1304898 | 310 | 335 | 24 | 0.2 |
| 1158491 | 131 | 155 | 27 | 0.2 |
| 1304900 | 61 | 140 | 27 | 0.3 |
| 1158492 | 422 | 358 | 20 | 0.2 |
| 1304899 | 66 | 96 | 21 | 0.2 |
| 1158812 | 3116 | 2358 | 25 | 0.5 |
| 1304895 | 35 | 98 | 24 | 0.2 |
| 1158139 | 326 | 256 | 22 | 0.2 |
| 1304882 | 1931 | 797 | 23 | 0.2 |
| 1158168 | 1492 | 880 | 31 | 0.2 |
| 1304901 | 1790 | 1477 | 34 | 4.3 |
| 1157974 | 1664 | 1935 | 23 | 2.5 |
| 1304885 | 98 | 107 | 18 | 0.2 |

Body weights of CD-1 male mice were measured at days 1 and 25, and the average body weight for each group is presented in the table below. Liver, kidney and spleen weights were measured at the end of the study and are presented in the table below. Modified oligonucleotides that caused any changes in organ weights outside the expected range for modified oligonucleotides were excluded from further studies.

TABLE 92

Body and organ weights (in grams)

| ION No. | Body Weight (g) | Liver (g) | Kidney (g) | Spleen (g) |
|---|---|---|---|---|
| PBS | 32 | 1.6 | 0.5 | 0.1 |
| 1157032 | 32 | 2 | 0.5 | 0.2 |
| 1304893 | 35 | 2 | 0.5 | 0.1 |
| 1157919 | 34 | 2.4 | 0.4 | 0.2 |
| 1304889 | 35 | 1.9 | 0.5 | 0.2 |
| 1157936 | 38 | 2.1 | 0.6 | 0.1 |
| 1304906 *** | 34 | 1.8 | 0.5 | 0.1 |
| 1157970 | 33 | 2.2 | 0.4 | 0.2 |
| 1304890 *** | 36 | 2 | 0.5 | 0.2 |
| 1157972 | 30 | 2.4 | 0.4 | 0.1 |
| 1304888 | 35 | 1.9 | 0.5 | 0.1 |
| 1157993 | 36 | 2.5 | 0.5 | 0.3 |
| 1304903 | 36 | 2.3 | 0.5 | 0.2 |
| 1158002 | 34 | 2.1 | 0.5 | 0.2 |
| 1304883 | 35 | 2 | 0.6 | 0.2 |
| 1158162 | 35 | 2 | 0.5 | 0.1 |
| 1304898 | 37 | 2.4 | 0.6 | 0.2 |
| 1158491 | 36 | 2.1 | 0.5 | 0.2 |
| 1304900 | 34 | 1.9 | 0.6 | 0.3 |
| 1158492 | 36 | 2 | 0.6 | 0.2 |
| 1304899 | 35 | 2 | 0.5 | 0.2 |
| 1158812 | 27 | 1.9 | 0.4 | 0.1 |
| 1304895 | 37 | 1.9 | 0.5 | 0.2 |
| 1158139 | 34 | 2.6 | 0.5 | 0.1 |
| 1304882 | 32 | 3.1 | 0.5 | 0.1 |
| 1158168 | 37 | 5.4 | 0.5 | 0.2 |
| 1304901 | 32 | 5 | 0.5 | 0.2 |
| 1157974 | 26 | 1.2 | 0.5 | 0.1 |
| 1304885 | 36 | 2.3 | 0.6 | 0.2 |

Study 4

Groups of four 4-to-6-week-old male CD-1 mice were injected subcutaneously twice a week for 4 weeks (for a total of 8 treatments) with 50 mg/kg/dose of modified oligonucleotides. One group of four male CD-1 mice was injected with PBS. Mice were euthanized 72 hours following the final administration. The values for modified oligonucleotides marked with a triple asterisk in the tables below have been previously presented in Tables 15 and 16 herein above. The data for modified oligonucleotides marked with a triple asterisk (***) in the tables below is identical to the data presented in Table 15 and Table 16 as the data is from the same experiments.

To evaluate the effect of modified oligonucleotides on liver and kidney function, plasma levels of alanine aminotransferase (ALT), aspartate aminotransferase (AST), blood urea nitrogen (BUN), and total bilirubin (TBIL) were measured using an automated clinical chemistry analyzer (Hitachi Olympus AU400c, Melville, N.Y.). The results are presented in the table below. Assays include four animals in a group, except where an asterisk (*) indicates that 3 animals or less was used for a specific assay. Modified oligonucleotides that caused changes in the levels of any of the liver or kidney function markers outside the expected range for modified oligonucleotides were excluded in further studies.

TABLE 93

Plasma chemistry markers in CD-1 Male mice

| Compound Number | ALT (IU/L) | AST (IU/L) | BUN (mg/dL) | TBIL (mg/dL) |
|---|---|---|---|---|
| PBS | 19 | 56 | 16 | 0.2 |
| 1304879 | 36 | 48 | 14 | 0.1 |
| 1304880 | 129 | 153 | 16 | 0.1 |
| 1304881 | 103 | 80 | 14 | 0.2 |
| 1304884 *** | 33 | 55 | 15 | 0.1 |
| 1304886 | 27 | 71 | 17 | 0.1 |
| 1304887 | 1531 | 1672 | 20 | 1.5 |
| 1304891 | 242 | 143 | 17 | 0.1 |
| 1304892 | 79 | 94 | 17 | 0.2 |
| 1304894 | 1009 | 569 | 19 | 0.2 |
| 1304896 | 51 | 54 | 15 | 0.2 |
| 1304897 | 99* | 106* | 16* | 0.1* |
| 1304902 | 34 | 47 | 16 | 0.1 |
| 1304904 | 29 | 52 | 15 | 0.1 |
| 1304905 | 737 | 389 | 16 | 0.1 |
| 1304907 | 102 | 84 | 14 | 0.1 |
| 1304908 | 71 | 69 | 17 | 0.1 |

Body weights of CD-1 male mice were measured at days 1 and 25, and the average body weight for each group is presented in the table below. Liver, kidney and spleen weights were measured at the end of the study and are presented in the table below. Modified oligonucleotides that caused any changes in organ weights outside the expected range for modified oligonucleotides were excluded from further studies.

TABLE 94

Body and organ weights (in grams)

| Compound Number | Body Weight (g) | Liver (g) | Kidney (g) | Spleen (g) |
|---|---|---|---|---|
| PBS | 34 | 2 | 0.5 | 0.1 |
| 1304879 | 34 | 2.2 | 0.5 | 0.1 |
| 1304880 | 36 | 2.5 | 0.5 | 0.2 |
| 1304881 | 34 | 2.2 | 0.5 | 0.2 |
| 1304884 *** | 37 | 2.2 | 0.5 | 0.2 |
| 1304886 | 38 | 2.2 | 0.6 | 0.1 |
| 1304887 | 33 | 2.9 | 0.4 | 0.1 |
| 1304891 | 37 | 3.2 | 0.5 | 0.2 |
| 1304892 | 35 | 2.3 | 0.5 | 0.2 |
| 1304894 | 33 | 1.7 | 0.4 | 0.1 |
| 1304896 | 35 | 2.1 | 0.5 | 0.1 |
| 1304897 | 35 | 2.2* | 0.5* | 0.2* |
| 1304902 | 39 | 2.4 | 0.6 | 0.2 |
| 1304904 | 37 | 2.2 | 0.5 | 0.2 |
| 1304905 | 38 | 2.6 | 0.5 | 0.2 |
| 1304907 | 36 | 1.9 | 0.5 | 0.1 |
| 1304908 | 37 | 2.3 | 0.6 | 0.3 |

Study 5

Groups of four 4-to-6-week-old male CD-1 mice were injected subcutaneously twice a week for 4 weeks (for a total of 8 treatments) with 50 mg/kg/dose of modified oligonucleotides. One group of four male CD-1 mice was injected with PBS. Mice were euthanized 24 hours following the final administration. The values for modified oligonucleotides marked with a triple asterisk in the tables below have been previously presented in Tables 9 and 10 herein above. The data for modified oligonucleotides marked with a triple asterisk (✱✱✱) in the tables below is identical to the data presented in Table 9 and Table 10 as the data is from the same experiments.

To evaluate the effect of modified oligonucleotides on liver and kidney function, plasma levels of alanine aminotransferase (ALT), aspartate aminotransferase (AST), blood urea nitrogen (BUN) and total bilirubin (TBIL) were measured using an automated clinical chemistry analyzer (Hitachi Olympus AU400c, Melville, N.Y.). The results are presented in the table below. Assays include four animals in a group, except where an asterisk (*) indicates that 3 animals or less was used for a specific assay. Modified oligonucleotides that caused changes in the levels of any of the liver or kidney function markers outside the expected range for modified oligonucleotides were excluded in further studies.

TABLE 95

Plasma chemistry markers in CD-1 Male mice

| Compound Number | ALT (IU/L) | AST (IU/L) | BUN (mg/dL) | TBIL (mg/dL) |
|---|---|---|---|---|
| PBS | 43 | 71 | 26 | 0.2 |
| 1157034 | 891 | 641 | 23 | 0.2 |
| 1157032 | 579 | 652 | 20 | 0.2 |
| 1157048 | 2247 | 2324 | 20 | 4.2 |
| 1157110 | 1408 | 966 | 25 | 0.3 |
| 1157111 ✱✱✱ | 341 | 200 | 22 | 0.2 |
| 1158139 | 651 | 307 | 25 | 0.2 |
| 1158614 | 8358* | 6909* | 37* | 4.6* |
| 1158615 | 1699 | 1170 | 30 | 0.3 |
| 1158168 | 3846 | 1734 | 27 | 10.7 |
| 1157974 | 1399 | 1957 | 16* | 1.1 |

Body weights of CD-1 male mice were measured at days 1 and 25, and the average body weight for each group is presented in the table below. Liver, kidney and spleen weights were measured at the end of the study and are presented in the table below. Modified oligonucleotides that caused any changes in organ weights outside the expected range for modified oligonucleotides were excluded from further studies.

TABLE 96

Body and organ weights (in grams)

| Compound Number | Body Weight (g) | Liver (g) | Kidney (g) | Spleen (g) |
|---|---|---|---|---|
| PBS | 37 | 2 | 0.6 | 0.1 |
| 1157032 | 35 | 2.3 | 0.4 | 0.2 |
| 1157034 | 33 | 2 | 0.4 | 0.1 |
| 1157048 | 31 | 2.7 | 0.4 | 0.1 |
| 1157110 | 32 | 1.8 | 0.5 | 0.2 |
| 1157111 ✱✱✱ | 38 | 2.8 | 0.5 | 0.2 |
| 1157974 | 30 | 1.6 | 0.5 | 0.2 |
| 1158139 | 34 | 3 | 0.4 | 0.1 |
| 1158168 | 31 | 5.1 | 0.4 | 0.1 |
| 1158614 | 27 | 3.2 | 0.4 | 0 |
| 1158615 | 26 | 1.6 | 0.3 | 0.1 |

Example 20: Tolerability of Modified Oligonucleotides Targeting Human MALAT1 in Sprague-Dawley Rats Sprague-Dawley rats are a multipurpose model used for safety and efficacy evaluations. The rats were treated with Ionis modified oligonucleotides from the studies described in the Examples above and evaluated for changes in the levels of various plasma chemistry markers.

Study 1

Groups of 4 Sprague-Dawley rats each were weekly injected subcutaneously with 50 mg/kg of Ionis oligonucleotide for 6 weeks (total 7 doses). The rats were euthanized; and organs, urine and plasma were harvested for further analysis 2 days after the last dose.

Plasma Chemistry Markers

To evaluate the effect of modified oligonucleotides on liver and kidney function, plasma levels of alanine aminotransferase (ALT), aspartate aminotransferase (AST), blood urea nitrogen (BUN) and total bilirubin (TBIL) were measured using an automated clinical chemistry analyzer (Hitachi Olympus AU400c, Melville, N.Y.). The results are presented in the table below. Assays include four animals in a group, except where an asterisk (*) indicates that 3 animals or less was used for a specific assay. Modified oligonucleotides that caused changes in the levels of any of the liver or kidney function markers outside the expected range for modified oligonucleotides were excluded in further studies.

TABLE 97

Plasma chemistry markers in Sprague-Dawley rats

| Compound Number | ALT (IU/L) | AST (IU/L) | BUN (mg/dL) | TBIL (mg/dL) |
|---|---|---|---|---|
| PBS | 65 | 133 | 16 | 0.7 |
| 1157034* | 333 | 292 | 195 | 0.8 |
| 1157111 | 37 | 73 | 31 | 0.2 |
| 1157190 | 47 | 83 | 19 | 0.2 |
| 1157929 | 42 | 74 | 20 | 0.2 |
| 1158161 | 92 | 117 | 22 | 0.2 |
| 1158162 | 882 | 700 | 96 | 1.7 |

Blood obtained from rat groups at the end of the study, day 43, were sent to IDEXX BioAnalytics for measurement of blood cell counts. Counts taken include red blood cell (RBC) count, Hemoglobin (HGB), Hematocrit (HCT), platelet count (PLT), total white blood cell count (WBC), neutrophil counts (NEU), lymphocyte counts (LYM), and monocyte counts (MON). The results are presented in the tables below. Ionis oligonucleotides that caused changes in the blood cell count outside the expected range for modified oligonucleotides were excluded in further studies.

TABLE 98

Blood Cell Count in Sprague-Dawley Rats

| Compound No. | RBC (×106/μL) | HGB (g/dL) | HCT (%) | PLT ($10^3$/μL) | WBC (×$10^3$/μL) | NEU (%) | LYM (%) | MON (%) |
|---|---|---|---|---|---|---|---|---|
| PBS | 8 | 15 | 44 | 667 | 8 | 18 | 75 | 5 |
| 1157034* | 6 | 11 | 32 | 836 | 15 | 42 | 53 | 5 |
| 1157111 | 6 | 11 | 34 | 677 | 17 | 32 | 62 | 5 |
| 1157190 | 6 | 12 | 35 | 632 | 10 | 19 | 76 | 4 |
| 1157929 | 7 | 12 | 36 | 771 | 9 | 25 | 69 | 5 |
| 1158161 | 7 | 13 | 36 | 1068 | 10 | 28 | 65 | 7 |
| 1158162 | 7 | 11 | 33 | 743 | 21 | 33 | 60 | 7 |

To evaluate the effect of Ionis oligonucleotides on kidney function, urinary levels of micro total protein (MTP) and creatinine were measured using an automated clinical chemistry analyzer (Hitachi Olympus AU400c, Melville, N.Y.). The ratios of MTP to creatinine (MTP/C ratio) are presented in the table below. Ionis oligonucleotides that caused changes in the levels of the ratio outside the expected range for modified oligonucleotides were excluded in further studies.

TABLE 99

MTP to creatinine ratio in Sprague-Dawley rats

| Compound Number | MTP/C Ratio |
|---|---|
| PBS | 3 |
| 1157034* | 837 |
| 1157111 | 77 |
| 1157190 | 11 |
| 1157929 | 15 |
| 1158161 | 13 |
| 1158162 | 161 |

Body weights of rats were measured at on day 41, and the average body weight for each group is presented in the table below. Liver, spleen and kidney weights were measured at the end of the study, and are presented in the table below. Ionis oligonucleotides that caused any changes in organ weights outside the expected range for modified oligonucleotides were excluded from further studies.

TABLE 100

Body and organ weights (g)

| Compound Number | Body Weight (g) | Liver (g) | Kidney (g) | Spleen (g) |
|---|---|---|---|---|
| PBS | 469 | 17 | 3.5 | 1.1 |
| 1157034* | 338 | 13 | 7.1 | 1.3 |
| 1157111 | 348 | 16 | 3.2 | 1.8 |
| 1157190 | 358 | 16 | 3.7 | 2.2 |
| 1157929 | 389 | 16 | 3.2 | 1.8 |
| 1158161 | 422 | 16 | 3.3 | 1.7 |
| 1158162 | 306 | 13 | 4.1 | 1.2 |

Study 2

Groups of 4 Sprague-Dawley rats each were weekly injected subcutaneously with 50 mg/kg of Ionis oligonucleotide for 6 weeks (total 7 doses). The rats were euthanized; and organs, urine and plasma were harvested for further analysis 1 day after the last dose.

Plasma Chemistry Markers

To evaluate the effect of modified oligonucleotides on liver and kidney function, plasma levels of alanine aminotransferase (ALT), aspartate aminotransferase (AST), blood urea nitrogen (BUN) and total bilirubin (TBIL) were measured using an automated clinical chemistry analyzer (Hitachi Olympus AU400c, Melville, N.Y.). The results are presented in the table below. Modified oligonucleotides that caused changes in the levels of any of the liver or kidney function markers outside the expected range for modified oligonucleotides were excluded in further studies.

TABLE 101

Plasma chemistry markers in Sprague-Dawley rats

| Compound Number | ALT (IU/L) | AST (IU/L) | BUN (mg/dL) | TBIL (mg/dL) |
|---|---|---|---|---|
| PBS | 70 | 66 | 15 | 0.12 |
| 1304884 | 70 | 85 | 19 | 0.11 |
| 1304890 | 49 | 78 | 18 | 0.11 |
| 1304906 | 77 | 103 | 18 | 0.15 |

Blood obtained from rat groups at the end of the study, day 43, were sent to IDEXX BioAnalytics for measurement of blood cell counts. Counts taken red blood cell (RBC) count, Hemoglobin (HGB), Hematocrit (HCT), platelet count (PLT), total white blood cell count (WBC), neutrophil counts (NEU), lymphocyte counts (LYM), and monocyte counts (MON). The results are presented in the tables below. Ionis oligonucleotides that caused changes in the blood cell count outside the expected range for modified oligonucleotides were excluded in further studies.

TABLE 102

Blood Cell Count in Sprague-Dawley Rats

| Compound No. | RBC (×106/μL) | HGB (g/dL) | HCT (%) | PLT ($10^3$/μL) | WBC (×$10^3$/μL) | NEU (%) | LYM (%) | MON (%) |
|---|---|---|---|---|---|---|---|---|
| PBS | 7 | 14 | 39 | 351 | 8 | 13 | 81 | 5 |
| 1E+06 | 7 | 14 | 39 | 450 | 11 | 17 | 79 | 4 |
| 1E+06 | 8 | 14 | 40 | 578 | 8 | 7 | 86 | 6 |
| 1E+06 | 8 | 15 | 41 | 545 | 10 | 15 | 78 | 7 |

To evaluate the effect of Ionis oligonucleotides on kidney function, urinary levels of micro total protein (MTP) and creatinine were measured using an automated clinical chemistry analyzer (Hitachi Olympus AU400c, Melville, N.Y.). The ratios of MTP to creatinine (MTP/C ratio) are presented in the table below. Ionis oligonucleotides that caused changes in the levels of the ratio outside the expected range for modified oligonucleotides were excluded in further studies.

TABLE 103

MTP to creatinine ratio in Sprague-Dawley rats

| Compound Number | MTP/C |
|---|---|
| PBS | 3 |
| 1304884 | 15 |
| 1304890 | 16 |
| 1304906 | 12 |

Body weights of rats were measured at days 1 and 38 and the average body weight for each group is presented in the table below. Liver, spleen and kidney weights were measured at the end of the study, and are presented in the table below. Ionis oligonucleotides that caused any changes in organ weights outside the expected range for modified oligonucleotides were excluded from further studies.

TABLE 104

Body and organ weights (g)

| Compound Number | Body Weight (g) | Liver (g) | Kidney (g) | Spleen (g) |
|---|---|---|---|---|
| PBS | 474 | 17.4 | 3.7 | 0.8 |
| 1E+06 | 385 | 15.5 | 3.3 | 1.9 |
| 1E+06 | 385 | 15 | 3.4 | 1.5 |
| 1E+06 | 404 | 15.1 | 3.4 | 2.1 |

SEQUENCE LISTING (2824 sequences)

SEQ ID NO: 1 - DNA, 8986 bp, Homo sapiens
ctctcccctccgcagcctgcagcccgagacttctgtaaaggactggggccccgcaactggcctctcctgccctcttaagcgcagcgccattttagcaacgcagaagcccggcgccgggaagcctcagctcgcctgaaggcaggtcccctctgacgcctccgggagcccaggtttcccagagtccttgggacgcagcgacgagttgtgctgctatcttagctgtccttataggctggccattccaggtggtggtatttagataaaaccactcaaactctgcagtttggtcttggggtttggaggaaagcttttatttttcttcctgctccggttcagaaggtctgaagctcatacctaaccaggcataacacagaatctgcaaaacaaaaacccctaaaaaagcagacccagagcagtgtaaacacttctgggtgtgtccctgactggctgcccaaggtctctgtgtcttcggagacaaagccattcgcttagttggtctactttaaaaggccacttgaactcgctttccatggcgatttgccttgtgagcactttcaggagagcctggaagctgaaaaacggtagaaaaatttccgtgcgggccgtggggggctggcggcaactggggggccgcagatcagagtgggccactggcagccaacggcccccggggctcaggcggggagcagctctgtggtgtgggattgaggcgttttccaagagtgggttttcacgtttctaagatttcccaagcagacagcccgtgctgctccgatttctcgaacaaaaaagcaaaacgtgtggctgtcttgggagcaagtcgcaggactgcaagcagttgggggagaaagtccgccattttgccacttctcaaccgtccctgcaaggctggggctcagttgcgtaatggaaagtaaagccctgaactatcacactttaatcttccttcaaaaggtggtaaactatacctactgtccctcaagagaacacaagaagtgctttaagaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagttttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctctaaattgttgtggttcttttgtgaataaaaaaatcttgattggggaaaaaagatgggtgttctgtgggcttgttctgttaaatctgtggtctataaacacagcacccataattacagcataatcttcaagtagggtacggactttgggggattggtgcgagggtagtgggtgagtggcctactaaaaagcccagtaacccccacaggaaaatagggaacttctttttaagtagcctcctttccactatttagtaattggctgtgagctgggctgggggagaaatggggcggggtgtgtgtgtcattggaaagctctcttttttgtttttttgagacagtctcactttgtcccccaggctggagtgtagtggcatgatctctgcaaactgcaacctccacttctggggtccaagtggttgtcctgcttcaccctccctgtagctgggactacaggtgcacaccaccacgcctggctaatttt

SEQ ID NO: 2 - DNA, 16 bp, Artificial sequence
  Synthetic oligonucleotide
ttcggtttaatctctt

SEQ ID NO: 3 - DNA, 16 bp, Artificial sequence
  Synthetic oligonucleotide
ggttaccaataatttc

SEQ ID NO: 4 - DNA, 16 bp, Artificial sequence
  Synthetic oligonucleotide
tggtaattactcttga

SEQ ID NO: 5 - DNA, 16 bp, Artificial sequence
  Synthetic oligonucleotide
gtagtaagaatctcag

SEQ ID NO: 6 - DNA, 16 bp, Artificial sequence
  Synthetic oligonucleotide
ccttagttggcatcaa

SEQ ID NO: 7 - DNA, 16 bp, Artificial sequence
  Synthetic oligonucleotide
tccttagttggcatca

SEQ ID NO: 8 - DNA, 16 bp, Artificial sequence
  Synthetic oligonucleotide
  misc_feature (5)..(5): bases at these positions are RNA
ggatuaatgtagtgta

SEQ ID NO: 9 - DNA, 16 bp, Artificial sequence
  Synthetic oligonucleotide
ggttatagcttgacaa

SEQ ID NO: 10 - DNA, 16 bp, Artificial sequence
  Synthetic oligonucleotide
gcagataatgttctca

SEQ ID NO: 11 - DNA, 20 bp, Artificial sequence
  Synthetic oligonucleotide
tgcctttaggattctagaca

SEQ ID NO: 12 - DNA, 20 bp, Artificial sequence
  Synthetic oligonucleotide
taattgccaatatttgcccc

SEQ ID NO: 13 - DNA, 20 bp, Artificial sequence
  Synthetic oligonucleotide
gggagttacttgccaacttg

SEQ ID NO: 14 - DNA, 20 bp, Artificial sequence
  Synthetic oligonucleotide
ttgcagttaaacaatggaaa

SEQ ID NO: 15 - DNA, 20 bp, Artificial sequence
  Synthetic oligonucleotide
ccaggctggttatgactcag

SEQ ID NO: 16 - DNA, 20 bp, Artificial sequence
  Synthetic oligonucleotide
ttatcaattcaccaaggagc

SEQ ID NO: 17 - DNA, 20 bp, Artificial sequence
  Synthetic oligonucleotide
atggaggtatgacatataat

SEQ ID NO: 18 - DNA, 20 bp, Artificial sequence
  Synthetic oligonucleotide
ggcatatgcagataatgttc

SEQ ID NO: 19 - DNA, 20 bp, Artificial sequence
  Synthetic oligonucleotide
acattggcacacagcacagc

SEQ ID NO: 20 - DNA, 20 bp, Artificial sequence
  Synthetic oligonucleotide
aggcaaacgaaacattggca

SEQ ID NO: 21 - DNA, 20 bp, Artificial sequence
  Synthetic oligonucleotide
ctaacatgcaatactgcaga

SEQ ID NO: 22 - DNA, 20 bp, Artificial sequence
  Synthetic oligonucleotide
aagcccacaggaacaagtcc

SEQ ID NO: 23 - DNA, 20 bp, Artificial sequence
  Synthetic oligonucleotide
ggtcaatagtgtaaaacatt

SEQ ID NO: 24 - DNA, 20 bp, Artificial sequence
  Synthetic oligonucleotide
ttcatgaaggatgaaatgcc

SEQ ID NO: 25 - DNA, 20 bp, Artificial sequence
  Synthetic oligonucleotide
caatgcattctaatagcagc

SEQ ID NO: 26 - DNA, 20 bp, Artificial sequence
  Synthetic oligonucleotide
aacatttccacttgccagtt

SEQ ID NO: 27 - DNA, 20 bp, Artificial sequence
  Synthetic oligonucleotide
ggttcccaatccccacattt

SEQ ID NO: 28 - DNA, 20 bp, Artificial sequence
  Synthetic oligonucleotide
taataaaaatcaggtgaggc

SEQ ID NO: 29 - DNA, 20 bp, Artificial sequence
  Synthetic oligonucleotide
tcccacccagcattacagtt

SEQ ID NO: 30 - DNA, 20 bp, Artificial sequence
  Synthetic oligonucleotide
taagatgctagcttggccaa

SEQ ID NO: 31 - DNA, 16 bp, Artificial sequence
  Synthetic oligonucleotide
gcattctaatagcagc

SEQ ID NO: 32 - DNA, 16 bp, Artificial sequence
  Synthetic oligonucleotide
agtactatagcatctg

SEQ ID NO: 33 - DNA, 20 bp, Artificial sequence
  Synthetic oligonucleotide
gccaggctggttatgactca

SEQ ID NO: 34 - DNA, 16 bp, Artificial sequence
  Synthetic oligonucleotide
gtcacaatgcattcta

SEQ ID NO: 35 - DNA, 19 bp, Artificial sequence
  Synthetic oligonucleotide
tttaagttctctggtatga

SEQ ID NO: 36 - DNA, 16 bp, Artificial sequence
  Synthetic oligonucleotide
ccataagtaagttcca

SEQ ID NO: 37 - DNA, 16 bp, Artificial sequence
  Synthetic oligonucleotide
cgggctgcaggctgcg

SEQ ID NO: 38 - DNA, 16 bp, Artificial sequence
  Synthetic oligonucleotide
acctgggctcccggag

SEQ ID NO: 39 - DNA, 16 bp, Artificial sequence
  Synthetic oligonucleotide
ggttttatctaaatac

SEQ ID NO: 40 - DNA, 16 bp, Artificial sequence
  Synthetic oligonucleotide
cctggttaggtatgag

SEQ ID NO: 41 - DNA, 16 bp, Artificial sequence
  Synthetic oligonucleotide
gaccaactaagcgaat

SEQ ID NO: 42 - DNA, 16 bp, Artificial sequence
  Synthetic oligonucleotide
aaggcaaatcgccatg

SEQ ID NO: 43 - DNA, 16 bp, Artificial sequence
  Synthetic oligonucleotide
gccccccacggcccgc

SEQ ID NO: 44 - DNA, 16 bp, Artificial sequence
  Synthetic oligonucleotide
cgtgaaaacccactct

SEQ ID NO: 45 - DNA, 16 bp, Artificial sequence
  Synthetic oligonucleotide
ccccaactgcttgcag

SEQ ID NO: 46 - DNA, 16 bp, Artificial sequence
  Synthetic oligonucleotide
ttacgcaactgagccc

SEQ ID NO: 47 - DNA, 16 bp, Artificial sequence
  Synthetic oligonucleotide
gtaggtatagtttacc

SEQ ID NO: 48 - DNA, 16 bp, Artificial sequence
  Synthetic oligonucleotide
aaacgggtcatcaaac

SEQ ID NO: 49 - DNA, 16 bp, Artificial sequence
  Synthetic oligonucleotide
acagcttatggaactt

SEQ ID NO: 50 - DNA, 16 bp, Artificial sequence
  Synthetic oligonucleotide
ggaattcgatcacctt

SEQ ID NO: 51 - DNA, 16 bp, Artificial sequence
  Synthetic oligonucleotide
accgcacagctcgggc

SEQ ID NO: 52 - DNA, 16 bp, Artificial sequence
  Synthetic oligonucleotide
tgtattaatctctatc

SEQ ID NO: 53 - DNA, 16 bp, Artificial sequence
  Synthetic oligonucleotide
acctccgtcatgtttt

SEQ ID NO: 54 - DNA, 16 bp, Artificial sequence
  Synthetic oligonucleotide
agatcgccttcaaatt

SEQ ID NO: 55 - DNA, 16 bp, Artificial sequence
  Synthetic oligonucleotide
tttaaatgacgcaatt

SEQ ID NO: 56 - DNA, 16 bp, Artificial sequence
  Synthetic oligonucleotide
tgcccttagctttttg

SEQ ID NO: 57 - DNA, 16 bp, Artificial sequence
  Synthetic oligonucleotide
gctttaccttctaact

SEQ ID NO: 58 - DNA, 16 bp, Artificial sequence
  Synthetic oligonucleotide
gctactatatttaagg

SEQ ID NO: 59 - DNA, 16 bp, Artificial sequence
  Synthetic oligonucleotide
tctgtgtagcacctgg

SEQ ID NO: 60 - DNA, 16 bp, Artificial sequence
  Synthetic oligonucleotide
tatcttcaccacgaac

SEQ ID NO: 61 - DNA, 16 bp, Artificial sequence
  Synthetic oligonucleotide
catcaccaaattgcac

SEQ ID NO: 62 - DNA, 16 bp, Artificial sequence
  Synthetic oligonucleotide
gtctaggatcctctac

SEQ ID NO: 63 - DNA, 16 bp, Artificial sequence
  Synthetic oligonucleotide
catattgccgacctca

SEQ ID NO: 64 - DNA, 16 bp, Artificial sequence
  Synthetic oligonucleotide
tttacacctcagtacg

SEQ ID NO: 65 - DNA, 16 bp, Artificial sequence
  Synthetic oligonucleotide
acaagattcatgagta

SEQ ID NO: 66 - DNA, 16 bp, Artificial sequence
  Synthetic oligonucleotide
catacaaactgcttac

SEQ ID NO: 67 - DNA, 16 bp, Artificial sequence
  Synthetic oligonucleotide
ccccgcctcagttaca

SEQ ID NO: 68 - DNA, 16 bp, Artificial sequence
  Synthetic oligonucleotide
cttgagtcatttgcct

SEQ ID NO: 69 - DNA, 16 bp, Artificial sequence
  Synthetic oligonucleotide
atggacatctcttcca

SEQ ID NO: 70 - DNA, 16 bp, Artificial sequence
  Synthetic oligonucleotide
gtactatagcatctgt

SEQ ID NO: 71 - DNA, 16 bp, Artificial sequence
  Synthetic oligonucleotide
tccagtccctgaaggt

SEQ ID NO: 72 - DNA, 16 bp, Artificial sequence
  Synthetic oligonucleotide
aacttcaacatttggc

SEQ ID NO: 73 - DNA, 16 bp, Artificial sequence
  Synthetic oligonucleotide
caattacctaaaccca

SEQ ID NO: 74 - DNA, 16 bp, Artificial sequence
  Synthetic oligonucleotide
ctaaatcattgggagt

SEQ ID NO: 75 - DNA, 16 bp, Artificial sequence
  Synthetic oligonucleotide
gctctatactttgaag

SEQ ID NO: 76 - DNA, 16 bp, Artificial sequence
  Synthetic oligonucleotide
ccaaacaacttttgca

SEQ ID NO: 77 - DNA, 16 bp, Artificial sequence
  Synthetic oligonucleotide
tagaatcttacttgat

SEQ ID NO: 78 - DNA, 16 bp, Artificial sequence
  Synthetic oligonucleotide
cctctaagagacattc

SEQ ID NO: 79 - DNA, 16 bp, Artificial sequence
  Synthetic oligonucleotide
aattcaccaaggagct

SEQ ID NO: 80 - DNA, 16 bp, Artificial sequence
  Synthetic oligonucleotide
agaatctcagggttat

SEQ ID NO: 81 - DNA, 16 bp, Artificial sequence
  Synthetic oligonucleotide
aaaatggtagattccg

SEQ ID NO: 82 - DNA, 16 bp, Artificial sequence
  Synthetic oligonucleotide
aggattaatgtagtgt

SEQ ID NO: 83 - DNA, 16 bp, Artificial sequence
  Synthetic oligonucleotide
ggcaaacgaaacattg

SEQ ID NO: 84 - DNA, 16 bp, Artificial sequence
  Synthetic oligonucleotide
ttatctgttaacagct

SEQ ID NO: 85 - DNA, 16 bp, Artificial sequence
  Synthetic oligonucleotide
gaactccacagctctt

SEQ ID NO: 86 - DNA, 16 bp, Artificial sequence
  Synthetic oligonucleotide
ggaacaagtcctacaa

SEQ ID NO: 87 - DNA, 16 bp, Artificial sequence
  Synthetic oligonucleotide
tggcatcaaggcactg

SEQ ID NO: 88 - DNA, 16 bp, Artificial sequence
  Synthetic oligonucleotide
ttttagcagtaacatc

SEQ ID NO: 89 - DNA, 16 bp, Artificial sequence
  Synthetic oligonucleotide
agtgttcgcagacaaa

SEQ ID NO: 90 - DNA, 16 bp, Artificial sequence
  Synthetic oligonucleotide
gcctctattgccatgt

SEQ ID NO: 91 - DNA, 16 bp, Artificial sequence
  Synthetic oligonucleotide
agacccctgactttct

SEQ ID NO: 92 - DNA, 16 bp, Artificial sequence
  Synthetic oligonucleotide
cctaccactctaagat

SEQ ID NO: 93 - DNA, 16 bp, Artificial sequence
  Synthetic oligonucleotide
tcaaaatcctgaatgg

SEQ ID NO: 94 - DNA, 16 bp, Artificial sequence
  Synthetic oligonucleotide
agtaagccccaccccc

SEQ ID NO: 95 - DNA, 16 bp, Artificial sequence
  Synthetic oligonucleotide
tagcagcgggatcaga

SEQ ID NO: 96 - DNA, 16 bp, Artificial sequence
  Synthetic oligonucleotide
ctttatcactcagctg

SEQ ID NO: 97 - DNA, 16 bp, Artificial sequence
  Synthetic oligonucleotide
tttaaggttgcatctg

SEQ ID NO: 98 - DNA, 16 bp, Artificial sequence
  Synthetic oligonucleotide
actagtggttcccaat

SEQ ID NO: 99 - DNA, 16 bp, Artificial sequence
  Synthetic oligonucleotide
cagaaaaagcttgttc

SEQ ID NO: 100 - DNA, 16 bp, Artificial sequence
  Synthetic oligonucleotide
gccaacacagtttgct

SEQ ID NO: 101 - DNA, 16 bp, Artificial sequence
  Synthetic oligonucleotide
gaccttaggataatag

SEQ ID NO: 102 - DNA, 16 bp, Artificial sequence
  Synthetic oligonucleotide
tcaagcattccttcgg

SEQ ID NO: 103 - DNA, 16 bp, Artificial sequence
  Synthetic oligonucleotide
aaaagtggttgcccgc

SEQ ID NO: 104 - DNA, 16 bp, Artificial sequence
  Synthetic oligonucleotide
tccaagctactggctg

SEQ ID NO: 105 - DNA, 16 bp, Artificial sequence
  Synthetic oligonucleotide
agacctcgacaccatc

SEQ ID NO: 106 - DNA, 16 bp, Artificial sequence
  Synthetic oligonucleotide
taatacccttctgtta

SEQ ID NO: 107 - DNA, 16 bp, Artificial sequence
  Synthetic oligonucleotide
cattacagttcttgaa

SEQ ID NO: 108 - DNA, 16 bp, Artificial sequence
  Synthetic oligonucleotide
gcattcccacccaaaa

SEQ ID NO: 109 - DNA, 16 bp, Artificial sequence
  Synthetic oligonucleotide
actgaagagcattgga

SEQ ID NO: 110 - DNA, 16 bp, Artificial sequence
  Synthetic oligonucleotide
cgccgcagggatttga

SEQ ID NO: 111 - DNA, 16 bp, Artificial sequence
  Synthetic oligonucleotide
caaggatgtatatagt

SEQ ID NO: 112 - DNA, 16 bp, Artificial sequence
  Synthetic oligonucleotide
ctgcaggctattacct

SEQ ID NO: 113 - DNA, 16 bp, Artificial sequence
  Synthetic oligonucleotide
aagtaagccccacccc

SEQ ID NO: 114 - DNA, 16 bp, Artificial sequence
  Synthetic oligonucleotide
cgccaacacagtttgc

SEQ ID NO: 115 - DNA, 16 bp, Artificial sequence
  Synthetic oligonucleotide
ctcgggctgcaggctg

SEQ ID NO: 116 - DNA, 16 bp, Artificial sequence
  Synthetic oligonucleotide
aacctgggctcccgga

SEQ ID NO: 117 - DNA, 16 bp, Artificial sequence
  Synthetic oligonucleotide
gagtggttttatctaa

SEQ ID NO: 118 - DNA, 16 bp, Artificial sequence
  Synthetic oligonucleotide
gcctggttaggtatga

SEQ ID NO: 119 - DNA, 16 bp, Artificial sequence
  Synthetic oligonucleotide
agaccaactaagcgaa

SEQ ID NO: 120 - DNA, 16 bp, Artificial sequence
  Synthetic oligonucleotide
caaggcaaatcgccat

SEQ ID NO: 121 - DNA, 16 bp, Artificial sequence
  Synthetic oligonucleotide
agccccccacggcccg

SEQ ID NO: 122 - DNA, 16 bp, Artificial sequence
  Synthetic oligonucleotide
ggaaatcttagaaacg

SEQ ID NO: 123 - DNA, 16 bp, Artificial sequence
  Synthetic oligonucleotide
cccccaactgcttgca

SEQ ID NO: 124 - DNA, 16 bp, Artificial sequence
  Synthetic oligonucleotide
attacgcaactgagcc

SEQ ID NO: 125 - DNA, 16 bp, Artificial sequence
  Synthetic oligonucleotide
agtaggtatagtttac

SEQ ID NO: 126 - DNA, 16 bp, Artificial sequence
  Synthetic oligonucleotide
taaacgggtcatcaaa

SEQ ID NO: 127 - DNA, 16 bp, Artificial sequence
  Synthetic oligonucleotide
cttaacagcttatgga

SEQ ID NO: 128 - DNA, 16 bp, Artificial sequence
  Synthetic oligonucleotide
cggaattcgatcacct

SEQ ID NO: 129 - DNA, 16 bp, Artificial sequence
  Synthetic oligonucleotide
taccgcacagctcggg

SEQ ID NO: 130 - DNA, 16 bp, Artificial sequence
  Synthetic oligonucleotide
gttgtattaatctcta

SEQ ID NO: 131 - DNA, 16 bp, Artificial sequence
  Synthetic oligonucleotide
caacctccgtcatgtt

SEQ ID NO: 132 - DNA, 16 bp, Artificial sequence
  Synthetic oligonucleotide
aagatcgccttcaaat

SEQ ID NO: 133 - DNA, 16 bp, Artificial sequence
  Synthetic oligonucleotide
ctttaaatgacgcaat

SEQ ID NO: 134 - DNA, 16 bp, Artificial sequence
  Synthetic oligonucleotide
cattttgcccttagct

SEQ ID NO: 135 - DNA, 16 bp, Artificial sequence
  Synthetic oligonucleotide
agctttaccttctaac

SEQ ID NO: 136 - DNA, 16 bp, Artificial sequence
  Synthetic oligonucleotide
actaagctactatatt

SEQ ID NO: 137 - DNA, 16 bp, Artificial sequence
  Synthetic oligonucleotide
ttggtaattactcttg

SEQ ID NO: 138 - DNA, 16 bp, Artificial sequence
  Synthetic oligonucleotide
atccacttctgtgtag

SEQ ID NO: 139 - DNA, 16 bp, Artificial sequence
  Synthetic oligonucleotide
ctatcttcaccacgaa

SEQ ID NO: 140 - DNA, 16 bp, Artificial sequence
  Synthetic oligonucleotide
accttcatcaccaaat

SEQ ID NO: 141 - DNA, 16 bp, Artificial sequence
  Synthetic oligonucleotide
ggtctaggatcctcta

SEQ ID NO: 142 - DNA, 16 bp, Artificial sequence
  Synthetic oligonucleotide
acatattgccgacctc

SEQ ID NO: 143 - DNA, 16 bp, Artificial sequence
  Synthetic oligonucleotide
ctttacacctcagtac

SEQ ID NO: 144 - DNA, 16 bp, Artificial sequence
  Synthetic oligonucleotide
gacaagattcatgagt

SEQ ID NO: 145 - DNA, 16 bp, Artificial sequence
  Synthetic oligonucleotide
ccccaactaaacatac

SEQ ID NO: 146 - DNA, 16 bp, Artificial sequence
  Synthetic oligonucleotide
cccccgcctcagttac

SEQ ID NO: 147 - DNA, 16 bp, Artificial sequence
  Synthetic oligonucleotide
accttgagtcatttgc

SEQ ID NO: 148 - DNA, 16 bp, Artificial sequence
  Synthetic oligonucleotide
aatggacatctcttcc

SEQ ID NO: 149 - DNA, 16 bp, Artificial sequence
  Synthetic oligonucleotide
tagtactatagcatct

SEQ ID NO: 150 - DNA, 16 bp, Artificial sequence
  Synthetic oligonucleotide
gataaaagcagctcca

SEQ ID NO: 151 - DNA, 16 bp, Artificial sequence
  Synthetic oligonucleotide
tattggaaaacttaac

SEQ ID NO: 152 - DNA, 16 bp, Artificial sequence
  Synthetic oligonucleotide
acaattacctaaaccc

SEQ ID NO: 153 - DNA, 16 bp, Artificial sequence
  Synthetic oligonucleotide
actaaatcattgggag

SEQ ID NO: 154 - DNA, 16 bp, Artificial sequence
  Synthetic oligonucleotide
agctctatactttgaa

SEQ ID NO: 155 - DNA, 16 bp, Artificial sequence
  Synthetic oligonucleotide
taccatatccaaacaa

SEQ ID NO: 156 - DNA, 16 bp, Artificial sequence
  Synthetic oligonucleotide
atagaatcttacttga

SEQ ID NO: 157 - DNA, 16 bp, Artificial sequence
  Synthetic oligonucleotide
ccctctaagagacatt

SEQ ID NO: 158 - DNA, 16 bp, Artificial sequence
  Synthetic oligonucleotide
tatcaattcaccaagg

SEQ ID NO: 159 - DNA, 16 bp, Artificial sequence
  Synthetic oligonucleotide
taagaatctcagggtt

SEQ ID NO: 160 - DNA, 16 bp, Artificial sequence
  Synthetic oligonucleotide
taaaatggtagattcc

SEQ ID NO: 161 - DNA, 16 bp, Artificial sequence
  Synthetic oligonucleotide
caggattaatgtagtg

SEQ ID NO: 162 - DNA, 16 bp, Artificial sequence
  Synthetic oligonucleotide
aggcaaacgaaacatt

SEQ ID NO: 163 - DNA, 16 bp, Artificial sequence
  Synthetic oligonucleotide
cttatctgttaacagc

SEQ ID NO: 164 - DNA, 16 bp, Artificial sequence
  Synthetic oligonucleotide
taagaactccacagct

SEQ ID NO: 165 - DNA, 16 bp, Artificial sequence
  Synthetic oligonucleotide
aggaacaagtcctaca

SEQ ID NO: 166 - DNA, 16 bp, Artificial sequence
  Synthetic oligonucleotide
ttggcatcaaggcact

SEQ ID NO: 167 - DNA, 16 bp, Artificial sequence
  Synthetic oligonucleotide
caatttacatcacaac

SEQ ID NO: 168 - DNA, 16 bp, Artificial sequence
  Synthetic oligonucleotide
agagtgttcgcagaca

SEQ ID NO: 169 - DNA, 16 bp, Artificial sequence
  Synthetic oligonucleotide
gagggcctctattgcc

SEQ ID NO: 170 - DNA, 16 bp, Artificial sequence
  Synthetic oligonucleotide
atagacccctgacttt

SEQ ID NO: 171 - DNA, 16 bp, Artificial sequence
  Synthetic oligonucleotide
gcctaccactctaaga

SEQ ID NO: 172 - DNA, 16 bp, Artificial sequence
  Synthetic oligonucleotide
gcaattcaaaatcctg

SEQ ID NO: 173 - DNA, 16 bp, Artificial sequence
  Synthetic oligonucleotide
atagcagcgggatcag

SEQ ID NO: 174 - DNA, 16 bp, Artificial sequence
  Synthetic oligonucleotide
cctttatcactcagct

SEQ ID NO: 175 - DNA, 16 bp, Artificial sequence
  Synthetic oligonucleotide
attttaaggttgcatc

SEQ ID NO: 176 - DNA, 16 bp, Artificial sequence
  Synthetic oligonucleotide
gaactagtggttccca

SEQ ID NO: 177 - DNA, 16 bp, Artificial sequence
  Synthetic oligonucleotide
ctgactttgtatgtaa

SEQ ID NO: 178 - DNA, 16 bp, Artificial sequence
  Synthetic oligonucleotide
tgaccttaggataata

SEQ ID NO: 179 - DNA, 16 bp, Artificial sequence
  Synthetic oligonucleotide
ttcaagcattccttcg

SEQ ID NO: 180 - DNA, 16 bp, Artificial sequence
  Synthetic oligonucleotide
gaaaagtggttgcccg

SEQ ID NO: 181 - DNA, 16 bp, Artificial sequence
  Synthetic oligonucleotide
atccaagctactggct

SEQ ID NO: 182 - DNA, 16 bp, Artificial sequence
  Synthetic oligonucleotide
aagacctcgacaccat

SEQ ID NO: 183 - DNA, 16 bp, Artificial sequence
  Synthetic oligonucleotide
ggttttaatacccttc

SEQ ID NO: 184 - DNA, 16 bp, Artificial sequence
  Synthetic oligonucleotide
gcattacagttcttga

SEQ ID NO: 185 - DNA, 16 bp, Artificial sequence
  Synthetic oligonucleotide
gtcttagcagagaatt

SEQ ID NO: 186 - DNA, 16 bp, Artificial sequence
  Synthetic oligonucleotide
tactgaagagcattgg

SEQ ID NO: 187 - DNA, 16 bp, Artificial sequence
  Synthetic oligonucleotide
agtcaaagcaaagacg

SEQ ID NO: 188 - DNA, 16 bp, Artificial sequence
  Synthetic oligonucleotide
tcaaggatgtatatag

SEQ ID NO: 189 - DNA, 16 bp, Artificial sequence
  Synthetic oligonucleotide
agctgcaggctattac

SEQ ID NO: 190 - DNA, 16 bp, Artificial sequence
  Synthetic oligonucleotide
gctttaaatgacgcaa

SEQ ID NO: 191 - DNA, 16 bp, Artificial sequence
  Synthetic oligonucleotide
tctcgggctgcaggct

SEQ ID NO: 192 - DNA, 16 bp, Artificial sequence
  Synthetic oligonucleotide
aaacctgggctcccgg

SEQ ID NO: 193 - DNA, 16 bp, Artificial sequence
  Synthetic oligonucleotide
tgagtggttttatcta

SEQ ID NO: 194 - DNA, 16 bp, Artificial sequence
  Synthetic oligonucleotide
gttatgcctggttagg

SEQ ID NO: 195 - DNA, 16 bp, Artificial sequence
  Synthetic oligonucleotide
tagaccaactaagcga

SEQ ID NO: 196 - DNA, 16 bp, Artificial sequence
  Synthetic oligonucleotide
acaaggcaaatcgcca

SEQ ID NO: 197 - DNA, 16 bp, Artificial sequence
  Synthetic oligonucleotide
cgccagccccccacgg

SEQ ID NO: 198 - DNA, 16 bp, Artificial sequence
  Synthetic oligonucleotide
cttgggaaatcttaga

SEQ ID NO: 199 - DNA, 16 bp, Artificial sequence
  Synthetic oligonucleotide
tcccccaactgcttgc

SEQ ID NO: 200 - DNA, 16 bp, Artificial sequence
  Synthetic oligonucleotide
cattacgcaactgagc

SEQ ID NO: 201 - DNA, 16 bp, Artificial sequence
  Synthetic oligonucleotide
cagtaggtatagttta

SEQ ID NO: 202 - DNA, 16 bp, Artificial sequence
  Synthetic oligonucleotide
ttaaacgggtcatcaa

SEQ ID NO: 203 - DNA, 16 bp, Artificial sequence
  Synthetic oligonucleotide
tcttaacagcttatgg

SEQ ID NO: 204 - DNA, 16 bp, Artificial sequence
  Synthetic oligonucleotide
ccggaattcgatcacc

SEQ ID NO: 205 - DNA, 16 bp, Artificial sequence
  Synthetic oligonucleotide
cctaccgcacagctcg

SEQ ID NO: 206 - DNA, 16 bp, Artificial sequence
  Synthetic oligonucleotide
tagttgtattaatctc

SEQ ID NO: 207 - DNA, 16 bp, Artificial sequence
  Synthetic oligonucleotide
tcaacctccgtcatgt

SEQ ID NO: 208 - DNA, 16 bp, Artificial sequence
  Synthetic oligonucleotide
aaagatcgccttcaaa

SEQ ID NO: 209 - DNA, 16 bp, Artificial sequence
  Synthetic oligonucleotide
tacattttgcccttag

SEQ ID NO: 210 - DNA, 16 bp, Artificial sequence
  Synthetic oligonucleotide
cgtaaacaccctcatc

SEQ ID NO: 211 - DNA, 16 bp, Artificial sequence
  Synthetic oligonucleotide
aactaagctactatat

SEQ ID NO: 212 - DNA, 16 bp, Artificial sequence
  Synthetic oligonucleotide
agttggtaattactct

SEQ ID NO: 213 - DNA, 16 bp, Artificial sequence
  Synthetic oligonucleotide
actgaatccacttctg

SEQ ID NO: 214 - DNA, 16 bp, Artificial sequence
  Synthetic oligonucleotide
cctatcttcaccacga

SEQ ID NO: 215 - DNA, 16 bp, Artificial sequence
  Synthetic oligonucleotide
ctaccttcatcaccaa

SEQ ID NO: 216 - DNA, 16 bp, Artificial sequence
  Synthetic oligonucleotide
tggtctaggatcctct

SEQ ID NO: 217 - DNA, 16 bp, Artificial sequence
  Synthetic oligonucleotide
aacatattgccgacct

SEQ ID NO: 218 - DNA, 16 bp, Artificial sequence
  Synthetic oligonucleotide
cctttacacctcagta

SEQ ID NO: 219 - DNA, 16 bp, Artificial sequence
  Synthetic oligonucleotide
agacaagattcatgag

SEQ ID NO: 220 - DNA, 16 bp, Artificial sequence
  Synthetic oligonucleotide
accccaactaaacata

SEQ ID NO: 221 - DNA, 16 bp, Artificial sequence
  Synthetic oligonucleotide
ccccccgcctcagtta

SEQ ID NO: 222 - DNA, 16 bp, Artificial sequence
  Synthetic oligonucleotide
caccttgagtcatttg

SEQ ID NO: 223 - DNA, 16 bp, Artificial sequence
  Synthetic oligonucleotide
caatggacatctcttc

SEQ ID NO: 224 - DNA, 16 bp, Artificial sequence
  Synthetic oligonucleotide
atagtactatagcatc

SEQ ID NO: 225 - DNA, 16 bp, Artificial sequence
  Synthetic oligonucleotide
ggataaaagcagctcc

SEQ ID NO: 226 - DNA, 16 bp, Artificial sequence
  Synthetic oligonucleotide
ccctcccctttaataa

SEQ ID NO: 227 - DNA, 16 bp, Artificial sequence
  Synthetic oligonucleotide
aacaattacctaaacc

SEQ ID NO: 228 - DNA, 16 bp, Artificial sequence
  Synthetic oligonucleotide
aactaaatcattggga

SEQ ID NO: 229 - DNA, 16 bp, Artificial sequence
  Synthetic oligonucleotide
ccaaaagctctatact

SEQ ID NO: 230 - DNA, 16 bp, Artificial sequence
  Synthetic oligonucleotide
ctaccatatccaaaca

SEQ ID NO: 231 - DNA, 16 bp, Artificial sequence
  Synthetic oligonucleotide
gcttacacacaactga

SEQ ID NO: 232 - DNA, 16 bp, Artificial sequence
  Synthetic oligonucleotide
accctctaagagacat

SEQ ID NO: 233 - DNA, 16 bp, Artificial sequence
  Synthetic oligonucleotide
ttatcaattcaccaag

SEQ ID NO: 234 - DNA, 16 bp, Artificial sequence
  Synthetic oligonucleotide
gtaagaatctcagggt

SEQ ID NO: 235 - DNA, 16 bp, Artificial sequence
  Synthetic oligonucleotide
gacaagcaattaactt

SEQ ID NO: 236 - DNA, 16 bp, Artificial sequence
  Synthetic oligonucleotide
ccaggattaatgtagt

SEQ ID NO: 237 - DNA, 16 bp, Artificial sequence
  Synthetic oligonucleotide
gaggcaaacgaaacat

SEQ ID NO: 238 - DNA, 16 bp, Artificial sequence
  Synthetic oligonucleotide
acttatctgttaacag

SEQ ID NO: 239 - DNA, 16 bp, Artificial sequence
  Synthetic oligonucleotide
ttaagaactccacagc

SEQ ID NO: 240 - DNA, 16 bp, Artificial sequence
  Synthetic oligonucleotide
caggaacaagtcctac

SEQ ID NO: 241 - DNA, 16 bp, Artificial sequence
  Synthetic oligonucleotide
tagttggcatcaaggc

SEQ ID NO: 242 - DNA, 16 bp, Artificial sequence
  Synthetic oligonucleotide
ctacacaatttacatc

SEQ ID NO: 243 - DNA, 16 bp, Artificial sequence
  Synthetic oligonucleotide
aaagagtgttcgcaga

SEQ ID NO: 244 - DNA, 16 bp, Artificial sequence
  Synthetic oligonucleotide
agagggcctctattgc

SEQ ID NO: 245 - DNA, 16 bp, Artificial sequence
  Synthetic oligonucleotide
tatagacccctgactt

SEQ ID NO: 246 - DNA, 16 bp, Artificial sequence
  Synthetic oligonucleotide
tgcctaccactctaag

SEQ ID NO: 247 - DNA, 16 bp, Artificial sequence
  Synthetic oligonucleotide
actcatatgcaattca

SEQ ID NO: 248 - DNA, 16 bp, Artificial sequence
  Synthetic oligonucleotide
caagtaagccccaccc

SEQ ID NO: 249 - DNA, 16 bp, Artificial sequence
  Synthetic oligonucleotide
aatagcagcgggatca

SEQ ID NO: 250 - DNA, 16 bp, Artificial sequence
  Synthetic oligonucleotide
gcctttatcactcagc

SEQ ID NO: 251 - DNA, 16 bp, Artificial sequence
  Synthetic oligonucleotide
gattttaaggttgcat

SEQ ID NO: 252 - DNA, 16 bp, Artificial sequence
  Synthetic oligonucleotide
agaactagtggttccc

SEQ ID NO: 253 - DNA, 16 bp, Artificial sequence
  Synthetic oligonucleotide
tctgactttgtatgta

SEQ ID NO: 254 - DNA, 16 bp, Artificial sequence
  Synthetic oligonucleotide
acgccaacacagtttg

SEQ ID NO: 255 - DNA, 16 bp, Artificial sequence
  Synthetic oligonucleotide
ttgaccttaggataat

SEQ ID NO: 256 - DNA, 16 bp, Artificial sequence
  Synthetic oligonucleotide
ggtacttcaagcattc

SEQ ID NO: 257 - DNA, 16 bp, Artificial sequence
  Synthetic oligonucleotide
ggaaaagtggttgccc

SEQ ID NO: 258 - DNA, 16 bp, Artificial sequence
  Synthetic oligonucleotide
gatccaagctactggc

SEQ ID NO: 259 - DNA, 16 bp, Artificial sequence
  Synthetic oligonucleotide
aaagacctcgacacca

SEQ ID NO: 260 - DNA, 16 bp, Artificial sequence
  Synthetic oligonucleotide
tggttttaataccctt

SEQ ID NO: 261 - DNA, 16 bp, Artificial sequence
  Synthetic oligonucleotide
agcattacagttcttg

SEQ ID NO: 262 - DNA, 16 bp, Artificial sequence
  Synthetic oligonucleotide
cctgaaaaagtcttag

SEQ ID NO: 263 - DNA, 16 bp, Artificial sequence
  Synthetic oligonucleotide
ctactgaagagcattg

SEQ ID NO: 264 - DNA, 16 bp, Artificial sequence
  Synthetic oligonucleotide
attagtagtcaaagca

SEQ ID NO: 265 - DNA, 16 bp, Artificial sequence
  Synthetic oligonucleotide
atcaaggatgtatata

SEQ ID NO: 266 - DNA, 16 bp, Artificial sequence
  Synthetic oligonucleotide
tagggcttctcaaaac

SEQ ID NO: 267 - DNA, 16 bp, Artificial sequence
  Synthetic oligonucleotide
tgaggcaaacgaaaca

SEQ ID NO: 268 - DNA, 16 bp, Artificial sequence
  Synthetic oligonucleotide
gtctcgggctgcaggc

SEQ ID NO: 269 - DNA, 16 bp, Artificial sequence
  Synthetic oligonucleotide
gaaacctgggctcccg

SEQ ID NO: 270 - DNA, 16 bp, Artificial sequence
  Synthetic oligonucleotide
gagtttgagtggtttt

SEQ ID NO: 271 - DNA, 16 bp, Artificial sequence
  Synthetic oligonucleotide
gtgttatgcctggtta

SEQ ID NO: 272 - DNA, 16 bp, Artificial sequence
  Synthetic oligonucleotide
gtagaccaactaagcg

SEQ ID NO: 273 - DNA, 16 bp, Artificial sequence
  Synthetic oligonucleotide
cacaaggcaaatcgcc

SEQ ID NO: 274 - DNA, 16 bp, Artificial sequence
  Synthetic oligonucleotide
cagttgccgccagccc

SEQ ID NO: 275 - DNA, 16 bp, Artificial sequence
  Synthetic oligonucleotide
gcttgggaaatcttag

SEQ ID NO: 276 - DNA, 16 bp, Artificial sequence
  Synthetic oligonucleotide
ctcccccaactgcttg

SEQ ID NO: 277 - DNA, 16 bp, Artificial sequence
  Synthetic oligonucleotide
ccattacgcaactgag

SEQ ID NO: 278 - DNA, 16 bp, Artificial sequence
  Synthetic oligonucleotide
acagtaggtatagttt

SEQ ID NO: 279 - DNA, 16 bp, Artificial sequence
  Synthetic oligonucleotide
tttaaacgggtcatca

SEQ ID NO: 280 - DNA, 16 bp, Artificial sequence
  Synthetic oligonucleotide
ttcttaacagcttatg

SEQ ID NO: 281 - DNA, 16 bp, Artificial sequence
  Synthetic oligonucleotide
accggaattcgatcac

SEQ ID NO: 282 - DNA, 16 bp, Artificial sequence
  Synthetic oligonucleotide
gcctaccgcacagctc

SEQ ID NO: 283 - DNA, 16 bp, Artificial sequence
  Synthetic oligonucleotide
gtagttgtattaatct

SEQ ID NO: 284 - DNA, 16 bp, Artificial sequence
  Synthetic oligonucleotide
ctcaacctccgtcatg

SEQ ID NO: 285 - DNA, 16 bp, Artificial sequence
  Synthetic oligonucleotide
aaaagatcgccttcaa

SEQ ID NO: 286 - DNA, 16 bp, Artificial sequence
  Synthetic oligonucleotide
ggctttaaatgacgca

SEQ ID NO: 287 - DNA, 16 bp, Artificial sequence
  Synthetic oligonucleotide
gtacattttgccctta

SEQ ID NO: 288 - DNA, 16 bp, Artificial sequence
  Synthetic oligonucleotide
aattggttctggtcta

SEQ ID NO: 289 - DNA, 16 bp, Artificial sequence
  Synthetic oligonucleotide
aaactaagctactata

SEQ ID NO: 290 - DNA, 16 bp, Artificial sequence
  Synthetic oligonucleotide
aagttggtaattactc

SEQ ID NO: 291 - DNA, 16 bp, Artificial sequence
  Synthetic oligonucleotide
gattcactgaatccac

SEQ ID NO: 292 - DNA, 16 bp, Artificial sequence
  Synthetic oligonucleotide
tcctatcttcaccacg

SEQ ID NO: 293 - DNA, 16 bp, Artificial sequence
  Synthetic oligonucleotide
ctgctaccttcatcac

SEQ ID NO: 294 - DNA, 16 bp, Artificial sequence
  Synthetic oligonucleotide
ctggcatgctggtcta

SEQ ID NO: 295 - DNA, 16 bp, Artificial sequence
  Synthetic oligonucleotide
caacatattgccgacc

SEQ ID NO: 296 - DNA, 16 bp, Artificial sequence
  Synthetic oligonucleotide
ccctttacacctcagt

SEQ ID NO: 297 - DNA, 16 bp, Artificial sequence
  Synthetic oligonucleotide
cagacaagattcatga

SEQ ID NO: 298 - DNA, 16 bp, Artificial sequence
  Synthetic oligonucleotide
taccccaactaaacat

SEQ ID NO: 299 - DNA, 16 bp, Artificial sequence
  Synthetic oligonucleotide
cccccccgcctcagtt

SEQ ID NO: 300 - DNA, 16 bp, Artificial sequence
  Synthetic oligonucleotide
acaccttgagtcattt

SEQ ID NO: 301 - DNA, 16 bp, Artificial sequence
  Synthetic oligonucleotide
ccaatggacatctctt

SEQ ID NO: 302 - DNA, 16 bp, Artificial sequence
  Synthetic oligonucleotide
aatagtactatagcat

SEQ ID NO: 303 - DNA, 16 bp, Artificial sequence
  Synthetic oligonucleotide
atactcttccaaggat

SEQ ID NO: 304 - DNA, 16 bp, Artificial sequence
  Synthetic oligonucleotide
ttgcccctccccttta

SEQ ID NO: 305 - DNA, 16 bp, Artificial sequence
  Synthetic oligonucleotide
ctaaacaattacctaa

SEQ ID NO: 306 - DNA, 16 bp, Artificial sequence
  Synthetic oligonucleotide
aaactaaatcattggg

SEQ ID NO: 307 - DNA, 16 bp, Artificial sequence
  Synthetic oligonucleotide
cccaaaagctctatac

SEQ ID NO: 308 - DNA, 16 bp, Artificial sequence
  Synthetic oligonucleotide
actaccatatccaaac

SEQ ID NO: 309 - DNA, 16 bp, Artificial sequence
  Synthetic oligonucleotide
tgcttacacacaactg

SEQ ID NO: 310 - DNA, 16 bp, Artificial sequence
  Synthetic oligonucleotide
caccctctaagagaca

SEQ ID NO: 311 - DNA, 16 bp, Artificial sequence
  Synthetic oligonucleotide
cttatcaattcaccaa

SEQ ID NO: 312 - DNA, 16 bp, Artificial sequence
  Synthetic oligonucleotide
agtaagaatctcaggg

SEQ ID NO: 313 - DNA, 16 bp, Artificial sequence
  Synthetic oligonucleotide
tgacaagcaattaact

SEQ ID NO: 314 - DNA, 16 bp, Artificial sequence
  Synthetic oligonucleotide
tccaggattaatgtag

SEQ ID NO: 315 - DNA, 16 bp, Artificial sequence
  Synthetic oligonucleotide
aacttatctgttaaca

SEQ ID NO: 316 - DNA, 16 bp, Artificial sequence
  Synthetic oligonucleotide
tatttaagaactccac

SEQ ID NO: 317 - DNA, 16 bp, Artificial sequence
  Synthetic oligonucleotide
acaggaacaagtccta

SEQ ID NO: 318 - DNA, 16 bp, Artificial sequence
  Synthetic oligonucleotide
ttagttggcatcaagg

SEQ ID NO: 319 - DNA, 16 bp, Artificial sequence
  Synthetic oligonucleotide
taatggttttctacac

SEQ ID NO: 320 - DNA, 16 bp, Artificial sequence
  Synthetic oligonucleotide
taaagagtgttcgcag

SEQ ID NO: 321 - DNA, 16 bp, Artificial sequence
  Synthetic oligonucleotide
tagagggcctctattg

SEQ ID NO: 322 - DNA, 16 bp, Artificial sequence
  Synthetic oligonucleotide
ttatagacccctgact

SEQ ID NO: 323 - DNA, 16 bp, Artificial sequence
  Synthetic oligonucleotide
ttgcctaccactctaa

SEQ ID NO: 324 - DNA, 16 bp, Artificial sequence
  Synthetic oligonucleotide
cactcatatgcaattc

SEQ ID NO: 325 - DNA, 16 bp, Artificial sequence
  Synthetic oligonucleotide
aacaagtaagccccac

SEQ ID NO: 326 - DNA, 16 bp, Artificial sequence
  Synthetic oligonucleotide
taatagcagcgggatc

SEQ ID NO: 327 - DNA, 16 bp, Artificial sequence
  Synthetic oligonucleotide
agcctttatcactcag

SEQ ID NO: 328 - DNA, 16 bp, Artificial sequence
  Synthetic oligonucleotide
tgattttaaggttgca

SEQ ID NO: 329 - DNA, 16 bp, Artificial sequence
  Synthetic oligonucleotide
aagaactagtggttcc

SEQ ID NO: 330 - DNA, 16 bp, Artificial sequence
  Synthetic oligonucleotide
tgatctgactttgtat

SEQ ID NO: 331 - DNA, 16 bp, Artificial sequence
  Synthetic oligonucleotide
cacgccaacacagttt

SEQ ID NO: 332 - DNA, 16 bp, Artificial sequence
  Synthetic oligonucleotide
cttgaccttaggataa

SEQ ID NO: 333 - DNA, 16 bp, Artificial sequence
  Synthetic oligonucleotide
gggtacttcaagcatt

SEQ ID NO: 334 - DNA, 16 bp, Artificial sequence
  Synthetic oligonucleotide
gggaaaagtggttgcc

SEQ ID NO: 335 - DNA, 16 bp, Artificial sequence
  Synthetic oligonucleotide
ggatccaagctactgg

SEQ ID NO: 336 - DNA, 16 bp, Artificial sequence
  Synthetic oligonucleotide
caaagacctcgacacc

SEQ ID NO: 337 - DNA, 16 bp, Artificial sequence
  Synthetic oligonucleotide
ctgtggttttaatacc

SEQ ID NO: 338 - DNA, 16 bp, Artificial sequence
  Synthetic oligonucleotide
ccagcattacagttct

SEQ ID NO: 339 - DNA, 16 bp, Artificial sequence
  Synthetic oligonucleotide
gttatgttcacctgaa

SEQ ID NO: 340 - DNA, 16 bp, Artificial sequence
  Synthetic oligonucleotide
cctactgaagagcatt

SEQ ID NO: 341 - DNA, 16 bp, Artificial sequence
  Synthetic oligonucleotide
gattagtagtcaaagc

SEQ ID NO: 342 - DNA, 16 bp, Artificial sequence
  Synthetic oligonucleotide
catcaaggatgtatat

SEQ ID NO: 343 - DNA, 16 bp, Artificial sequence
  Synthetic oligonucleotide
cagtagggcttctcaa

SEQ ID NO: 344 - DNA, 16 bp, Artificial sequence
  Synthetic oligonucleotide
agtctcgggctgcagg

SEQ ID NO: 345 - DNA, 16 bp, Artificial sequence
  Synthetic oligonucleotide
gactctgggaaacctg

SEQ ID NO: 346 - DNA, 16 bp, Artificial sequence
  Synthetic oligonucleotide
cagagtttgagtggtt

SEQ ID NO: 347 - DNA, 16 bp, Artificial sequence
  Synthetic oligonucleotide
tgtgttatgcctggtt

SEQ ID NO: 348 - DNA, 16 bp, Artificial sequence
  Synthetic oligonucleotide
agtagaccaactaagc

SEQ ID NO: 349 - DNA, 16 bp, Artificial sequence
  Synthetic oligonucleotide
tcacaaggcaaatcgc

SEQ ID NO: 350 - DNA, 16 bp, Artificial sequence
  Synthetic oligonucleotide
ccccagttgccgccag

SEQ ID NO: 351 - DNA, 16 bp, Artificial sequence
  Synthetic oligonucleotide
tgcttgggaaatctta

SEQ ID NO: 352 - DNA, 16 bp, Artificial sequence
  Synthetic oligonucleotide
gactttctcccccaac

SEQ ID NO: 353 - DNA, 16 bp, Artificial sequence
  Synthetic oligonucleotide
tccattacgcaactga

SEQ ID NO: 354 - DNA, 16 bp, Artificial sequence
  Synthetic oligonucleotide
gacagtaggtatagtt

SEQ ID NO: 355 - DNA, 16 bp, Artificial sequence
  Synthetic oligonucleotide
ttttaaacgggtcatc

SEQ ID NO: 356 - DNA, 16 bp, Artificial sequence
  Synthetic oligonucleotide
aggttctagttttact

SEQ ID NO: 357 - DNA, 16 bp, Artificial sequence
  Synthetic oligonucleotide
caccggaattcgatca

SEQ ID NO: 358 - DNA, 16 bp, Artificial sequence
  Synthetic oligonucleotide
tgcctaccgcacagct

SEQ ID NO: 359 - DNA, 16 bp, Artificial sequence
  Synthetic oligonucleotide
agtagttgtattaatc

SEQ ID NO: 360 - DNA, 16 bp, Artificial sequence
  Synthetic oligonucleotide
tctcaacctccgtcat

SEQ ID NO: 361 - DNA, 16 bp, Artificial sequence
  Synthetic oligonucleotide
taaaagatcgccttca

SEQ ID NO: 362 - DNA, 16 bp, Artificial sequence
  Synthetic oligonucleotide
aggctttaaatgacgc

SEQ ID NO: 363 - DNA, 16 bp, Artificial sequence
  Synthetic oligonucleotide
cttctaagtttgtaca

SEQ ID NO: 364 - DNA, 16 bp, Artificial sequence
  Synthetic oligonucleotide
aaattggttctggtct

SEQ ID NO: 365 - DNA, 16 bp, Artificial sequence
  Synthetic oligonucleotide
caaactaagctactat

SEQ ID NO: 366 - DNA, 16 bp, Artificial sequence
  Synthetic oligonucleotide
taagttggtaattact

SEQ ID NO: 367 - DNA, 16 bp, Artificial sequence
  Synthetic oligonucleotide
agattcactgaatcca

SEQ ID NO: 368 - DNA, 16 bp, Artificial sequence
  Synthetic oligonucleotide
ggactcttttcctatc

SEQ ID NO: 369 - DNA, 16 bp, Artificial sequence
  Synthetic oligonucleotide
cctgctaccttcatca

SEQ ID NO: 370 - DNA, 16 bp, Artificial sequence
  Synthetic oligonucleotide
cacactggcatgctgg

SEQ ID NO: 371 - DNA, 16 bp, Artificial sequence
  Synthetic oligonucleotide
acaacatattgccgac

SEQ ID NO: 372 - DNA, 16 bp, Artificial sequence
  Synthetic oligonucleotide
tccctttacacctcag

SEQ ID NO: 373 - DNA, 16 bp, Artificial sequence
  Synthetic oligonucleotide
tcagacaagattcatg

SEQ ID NO: 374 - DNA, 16 bp, Artificial sequence
  Synthetic oligonucleotide
ttaccccaactaaaca

SEQ ID NO: 375 - DNA, 16 bp, Artificial sequence
  Synthetic oligonucleotide
tcccccccgcctcagt

SEQ ID NO: 376 - DNA, 16 bp, Artificial sequence
  Synthetic oligonucleotide
tacaccttgagtcatt

SEQ ID NO: 377 - DNA, 16 bp, Artificial sequence
  Synthetic oligonucleotide
tccaatggacatctct

SEQ ID NO: 378 - DNA, 16 bp, Artificial sequence
  Synthetic oligonucleotide
caatagtactatagca

SEQ ID NO: 379 - DNA, 16 bp, Artificial sequence
  Synthetic oligonucleotide
aatactcttccaagga

SEQ ID NO: 380 - DNA, 16 bp, Artificial sequence
  Synthetic oligonucleotide
atatttgcccctcccc

SEQ ID NO: 381 - DNA, 16 bp, Artificial sequence
  Synthetic oligonucleotide
actaaacaattaccta

SEQ ID NO: 382 - DNA, 16 bp, Artificial sequence
  Synthetic oligonucleotide
taacttcccccagctt

SEQ ID NO: 383 - DNA, 16 bp, Artificial sequence
  Synthetic oligonucleotide
ccccaaaagctctata

SEQ ID NO: 384 - DNA, 16 bp, Artificial sequence
  Synthetic oligonucleotide
cactaccatatccaaa

SEQ ID NO: 385 - DNA, 16 bp, Artificial sequence
  Synthetic oligonucleotide
ttgcttacacacaact

SEQ ID NO: 386 - DNA, 16 bp, Artificial sequence
  Synthetic oligonucleotide
ccaccctctaagagac

SEQ ID NO: 387 - DNA, 16 bp, Artificial sequence
  Synthetic oligonucleotide
acttatcaattcacca

SEQ ID NO: 388 - DNA, 16 bp, Artificial sequence
  Synthetic oligonucleotide
tagtaagaatctcagg

SEQ ID NO: 389 - DNA, 16 bp, Artificial sequence
  Synthetic oligonucleotide
ttgacaagcaattaac

SEQ ID NO: 390 - DNA, 16 bp, Artificial sequence
  Synthetic oligonucleotide
ttccaggattaatgta

SEQ ID NO: 391 - DNA, 16 bp, Artificial sequence
  Synthetic oligonucleotide
ctgaggcaaacgaaac

SEQ ID NO: 392 - DNA, 16 bp, Artificial sequence
  Synthetic oligonucleotide
gttaaacttatctgtt

SEQ ID NO: 393 - DNA, 16 bp, Artificial sequence
  Synthetic oligonucleotide
gatatttaagaactcc

SEQ ID NO: 394 - DNA, 16 bp, Artificial sequence
  Synthetic oligonucleotide
cacaggaacaagtcct

SEQ ID NO: 395 - DNA, 16 bp, Artificial sequence
  Synthetic oligonucleotide
cttagttggcatcaag

SEQ ID NO: 396 - DNA, 16 bp, Artificial sequence
  Synthetic oligonucleotide
taaggagacagctttc

SEQ ID NO: 397 - DNA, 16 bp, Artificial sequence
  Synthetic oligonucleotide
ttaaagagtgttcgca

SEQ ID NO: 398 - DNA, 16 bp, Artificial sequence
  Synthetic oligonucleotide
ttagagggcctctatt

SEQ ID NO: 399 - DNA, 16 bp, Artificial sequence
  Synthetic oligonucleotide
tttatagacccctgac

SEQ ID NO: 400 - DNA, 16 bp, Artificial sequence
  Synthetic oligonucleotide
acattgcctaccactc

SEQ ID NO: 401 - DNA, 16 bp, Artificial sequence
  Synthetic oligonucleotide
gcactcatatgcaatt

SEQ ID NO: 402 - DNA, 16 bp, Artificial sequence
  Synthetic oligonucleotide
caacaagtaagcccca

SEQ ID NO: 403 - DNA, 16 bp, Artificial sequence
  Synthetic oligonucleotide
ctaatagcagcgggat

SEQ ID NO: 404 - DNA, 16 bp, Artificial sequence
  Synthetic oligonucleotide
cagcctttatcactca

SEQ ID NO: 405 - DNA, 16 bp, Artificial sequence
  Synthetic oligonucleotide
ctgattttaaggttgc

SEQ ID NO: 406 - DNA, 16 bp, Artificial sequence
  Synthetic oligonucleotide
aaagaactagtggttc

SEQ ID NO: 407 - DNA, 16 bp, Artificial sequence
  Synthetic oligonucleotide
actgatctgactttgt

SEQ ID NO: 408 - DNA, 16 bp, Artificial sequence
  Synthetic oligonucleotide
ccacgccaacacagtt

SEQ ID NO: 409 - DNA, 16 bp, Artificial sequence
  Synthetic oligonucleotide
cttctcttgaccttag

SEQ ID NO: 410 - DNA, 16 bp, Artificial sequence
  Synthetic oligonucleotide
ttaagagaagcccagg

SEQ ID NO: 411 - DNA, 16 bp, Artificial sequence
  Synthetic oligonucleotide
tagggaaaagtggttg

SEQ ID NO: 412 - DNA, 16 bp, Artificial sequence
  Synthetic oligonucleotide
aggatccaagctactg

SEQ ID NO: 413 - DNA, 16 bp, Artificial sequence
  Synthetic oligonucleotide
ccaaagacctcgacac

SEQ ID NO: 414 - DNA, 16 bp, Artificial sequence
  Synthetic oligonucleotide
gctgtggttttaatac

SEQ ID NO: 415 - DNA, 16 bp, Artificial sequence
  Synthetic oligonucleotide
cccagcattacagttc

SEQ ID NO: 416 - DNA, 16 bp, Artificial sequence
  Synthetic oligonucleotide
tgttatgttcacctga

SEQ ID NO: 417 - DNA, 16 bp, Artificial sequence
  Synthetic oligonucleotide
ccctactgaagagcat

SEQ ID NO: 418 - DNA, 16 bp, Artificial sequence
  Synthetic oligonucleotide
agattagtagtcaaag

SEQ ID NO: 419 - DNA, 16 bp, Artificial sequence
  Synthetic oligonucleotide
acatcaaggatgtata

SEQ ID NO: 420 - DNA, 16 bp, Artificial sequence
  Synthetic oligonucleotide
gcagtagggcttctca

SEQ ID NO: 421 - DNA, 16 bp, Artificial sequence
  Synthetic oligonucleotide
ctccaatggacatctc

SEQ ID NO: 422 - DNA, 16 bp, Artificial sequence
  Synthetic oligonucleotide
aagtctcgggctgcag

SEQ ID NO: 423 - DNA, 16 bp, Artificial sequence
  Synthetic oligonucleotide
agatagcagcacaact

SEQ ID NO: 424 - DNA, 16 bp, Artificial sequence
  Synthetic oligonucleotide
gcagagtttgagtggt

SEQ ID NO: 425 - DNA, 16 bp, Artificial sequence
  Synthetic oligonucleotide
ctgtgttatgcctggt

SEQ ID NO: 426 - DNA, 16 bp, Artificial sequence
  Synthetic oligonucleotide
aagtagaccaactaag

SEQ ID NO: 427 - DNA, 16 bp, Artificial sequence
  Synthetic oligonucleotide
ctcacaaggcaaatcg

SEQ ID NO: 428 - DNA, 16 bp, Artificial sequence
  Synthetic oligonucleotide
gccccccagttgccgc

SEQ ID NO: 429 - DNA, 16 bp, Artificial sequence
  Synthetic oligonucleotide
cacgggctgtctgctt

SEQ ID NO: 430 - DNA, 16 bp, Artificial sequence
  Synthetic oligonucleotide
ggactttctcccccaa

SEQ ID NO: 431 - DNA, 16 bp, Artificial sequence
  Synthetic oligonucleotide
ttccattacgcaactg

SEQ ID NO: 432 - DNA, 16 bp, Artificial sequence
  Synthetic oligonucleotide
ggacagtaggtatagt

SEQ ID NO: 433 - DNA, 16 bp, Artificial sequence
  Synthetic oligonucleotide
attttaaacgggtcat

SEQ ID NO: 434 - DNA, 16 bp, Artificial sequence
  Synthetic oligonucleotide
cggttaaaaataggtt

SEQ ID NO: 435 - DNA, 16 bp, Artificial sequence
  Synthetic oligonucleotide
tcaccggaattcgatc

SEQ ID NO: 436 - DNA, 16 bp, Artificial sequence
  Synthetic oligonucleotide
atgcctaccgcacagc

SEQ ID NO: 437 - DNA, 16 bp, Artificial sequence
  Synthetic oligonucleotide
aacctattgactatat

SEQ ID NO: 438 - DNA, 16 bp, Artificial sequence
  Synthetic oligonucleotide
atctcaacctccgtca

SEQ ID NO: 439 - DNA, 16 bp, Artificial sequence
  Synthetic oligonucleotide
ttaaaagatcgccttc

SEQ ID NO: 440 - DNA, 16 bp, Artificial sequence
  Synthetic oligonucleotide
taggctttaaatgacg

SEQ ID NO: 441 - DNA, 16 bp, Artificial sequence
  Synthetic oligonucleotide
tcttctaagtttgtac

SEQ ID NO: 442 - DNA, 16 bp, Artificial sequence
  Synthetic oligonucleotide
taaattggttctggtc

SEQ ID NO: 443 - DNA, 16 bp, Artificial sequence
  Synthetic oligonucleotide
tcaaactaagctacta

SEQ ID NO: 444 - DNA, 16 bp, Artificial sequence
  Synthetic oligonucleotide
ttaagttggtaattac

SEQ ID NO: 445 - DNA, 16 bp, Artificial sequence
  Synthetic oligonucleotide
tagattcactgaatcc

SEQ ID NO: 446 - DNA, 16 bp, Artificial sequence
  Synthetic oligonucleotide
cgcactggctcctgga

SEQ ID NO: 447 - DNA, 16 bp, Artificial sequence
  Synthetic oligonucleotide
gcctgctaccttcatc

SEQ ID NO: 448 - DNA, 16 bp, Artificial sequence
  Synthetic oligonucleotide
ttggcacactggcatg

SEQ ID NO: 449 - DNA, 16 bp, Artificial sequence
  Synthetic oligonucleotide
aaacaacatattgccg

SEQ ID NO: 450 - DNA, 16 bp, Artificial sequence
  Synthetic oligonucleotide
atccctttacacctca

SEQ ID NO: 451 - DNA, 16 bp, Artificial sequence
  Synthetic oligonucleotide
ttcagacaagattcat

SEQ ID NO: 452 - DNA, 16 bp, Artificial sequence
  Synthetic oligonucleotide
attaccccaactaaac

SEQ ID NO: 453 - DNA, 16 bp, Artificial sequence
  Synthetic oligonucleotide
ctcccccccgcctcag

SEQ ID NO: 454 - DNA, 16 bp, Artificial sequence
  Synthetic oligonucleotide
ttacaccttgagtcat

SEQ ID NO: 455 - DNA, 16 bp, Artificial sequence
  Synthetic oligonucleotide
tcaatagtactatagc

SEQ ID NO: 456 - DNA, 16 bp, Artificial sequence
  Synthetic oligonucleotide
gaatactcttccaagg

SEQ ID NO: 457 - DNA, 16 bp, Artificial sequence
  Synthetic oligonucleotide
aatatttgcccctccc

SEQ ID NO: 458 - DNA, 16 bp, Artificial sequence
  Synthetic oligonucleotide
ctgcaatcataaacta

SEQ ID NO: 459 - DNA, 16 bp, Artificial sequence
  Synthetic oligonucleotide
ttaacttcccccagct

SEQ ID NO: 460 - DNA, 16 bp, Artificial sequence
  Synthetic oligonucleotide
cagttcaatactttcc

SEQ ID NO: 461 - DNA, 16 bp, Artificial sequence
  Synthetic oligonucleotide
acacactaccatatcc

SEQ ID NO: 462 - DNA, 16 bp, Artificial sequence
  Synthetic oligonucleotide
aaacttgcttacacac

SEQ ID NO: 463 - DNA, 16 bp, Artificial sequence
  Synthetic oligonucleotide
cccaccctctaagaga

SEQ ID NO: 464 - DNA, 16 bp, Artificial sequence
  Synthetic oligonucleotide
tacttatcaattcacc

SEQ ID NO: 465 - DNA, 16 bp, Artificial sequence
  Synthetic oligonucleotide
cttgacaagcaattaa

SEQ ID NO: 466 - DNA, 16 bp, Artificial sequence
  Synthetic oligonucleotide
tattccaggattaatg

SEQ ID NO: 467 - DNA, 16 bp, Artificial sequence
  Synthetic oligonucleotide
gtctgaggcaaacgaa

SEQ ID NO: 468 - DNA, 16 bp, Artificial sequence
  Synthetic oligonucleotide
caagttaaacttatct

SEQ ID NO: 469 - DNA, 16 bp, Artificial sequence
  Synthetic oligonucleotide
gttgatatttaagaac

SEQ ID NO: 470 - DNA, 16 bp, Artificial sequence
  Synthetic oligonucleotide
ccacaggaacaagtcc

SEQ ID NO: 471 - DNA, 16 bp, Artificial sequence
  Synthetic oligonucleotide
taaataaggagacagc

SEQ ID NO: 472 - DNA, 16 bp, Artificial sequence
  Synthetic oligonucleotide
attaaagagtgttcgc

SEQ ID NO: 473 - DNA, 16 bp, Artificial sequence
  Synthetic oligonucleotide
tttagagggcctctat

SEQ ID NO: 474 - DNA, 16 bp, Artificial sequence
  Synthetic oligonucleotide
atttatagacccctga

SEQ ID NO: 475 - DNA, 16 bp, Artificial sequence
  Synthetic oligonucleotide
aaacattgcctaccac

SEQ ID NO: 476 - DNA, 16 bp, Artificial sequence
  Synthetic oligonucleotide
aagcactcatatgcaa

SEQ ID NO: 477 - DNA, 16 bp, Artificial sequence
  Synthetic oligonucleotide
acaacaagtaagcccc

SEQ ID NO: 478 - DNA, 16 bp, Artificial sequence
  Synthetic oligonucleotide
tctaatagcagcggga

SEQ ID NO: 479 - DNA, 16 bp, Artificial sequence
  Synthetic oligonucleotide
tcagcctttatcactc

SEQ ID NO: 480 - DNA, 16 bp, Artificial sequence
  Synthetic oligonucleotide
actgattttaaggttg

SEQ ID NO: 481 - DNA, 16 bp, Artificial sequence
  Synthetic oligonucleotide
tgaaagaactagtggt

SEQ ID NO: 482 - DNA, 16 bp, Artificial sequence
  Synthetic oligonucleotide
aactgatctgactttg

SEQ ID NO: 483 - DNA, 16 bp, Artificial sequence
  Synthetic oligonucleotide
ccccacgccaacacag

SEQ ID NO: 484 - DNA, 16 bp, Artificial sequence
  Synthetic oligonucleotide
acacttctcttgacct

SEQ ID NO: 485 - DNA, 16 bp, Artificial sequence
  Synthetic oligonucleotide
gttaagagaagcccag

SEQ ID NO: 486 - DNA, 16 bp, Artificial sequence
  Synthetic oligonucleotide
ctagggaaaagtggtt

SEQ ID NO: 487 - DNA, 16 bp, Artificial sequence
  Synthetic oligonucleotide
aaggatccaagctact

SEQ ID NO: 488 - DNA, 16 bp, Artificial sequence
  Synthetic oligonucleotide
accaaagacctcgaca

SEQ ID NO: 489 - DNA, 16 bp, Artificial sequence
  Synthetic oligonucleotide
tacttagctgtggttt

SEQ ID NO: 490 - DNA, 16 bp, Artificial sequence
  Synthetic oligonucleotide
acccagcattacagtt

SEQ ID NO: 491 - DNA, 16 bp, Artificial sequence
  Synthetic oligonucleotide
ctgttatgttcacctg

SEQ ID NO: 492 - DNA, 16 bp, Artificial sequence
  Synthetic oligonucleotide
gaccctactgaagagc

SEQ ID NO: 493 - DNA, 16 bp, Artificial sequence
  Synthetic oligonucleotide
acagattagtagtcaa

SEQ ID NO: 494 - DNA, 16 bp, Artificial sequence
  Synthetic oligonucleotide
tacatcaaggatgtat

SEQ ID NO: 495 - DNA, 16 bp, Artificial sequence
  Synthetic oligonucleotide
agcagtagggcttctc

SEQ ID NO: 496 - DNA, 16 bp, Artificial sequence
  Synthetic oligonucleotide
tgttaagagaagccca

SEQ ID NO: 497 - DNA, 16 bp, Artificial sequence
  Synthetic oligonucleotide
cagcagtagggcttct

SEQ ID NO: 498 - DNA, 16 bp, Artificial sequence
  Synthetic oligonucleotide
gaagtctcgggctgca

SEQ ID NO: 499 - DNA, 16 bp, Artificial sequence
  Synthetic oligonucleotide
aagatagcagcacaac

SEQ ID NO: 500 - DNA, 16 bp, Artificial sequence
  Synthetic oligonucleotide
ctgcagagtttgagtg

SEQ ID NO: 501 - DNA, 16 bp, Artificial sequence
  Synthetic oligonucleotide
tctgtgttatgcctgg

SEQ ID NO: 502 - DNA, 16 bp, Artificial sequence
  Synthetic oligonucleotide
taaagtagaccaacta

SEQ ID NO: 503 - DNA, 16 bp, Artificial sequence
  Synthetic oligonucleotide
gctcacaaggcaaatc

SEQ ID NO: 504 - DNA, 16 bp, Artificial sequence
  Synthetic oligonucleotide
cggccccccagttgcc

SEQ ID NO: 505 - DNA, 16 bp, Artificial sequence
  Synthetic oligonucleotide
gcacgggctgtctgct

SEQ ID NO: 506 - DNA, 16 bp, Artificial sequence
  Synthetic oligonucleotide
cggactttctccccca

SEQ ID NO: 507 - DNA, 16 bp, Artificial sequence
  Synthetic oligonucleotide
ctttccattacgcaac

SEQ ID NO: 508 - DNA, 16 bp, Artificial sequence
  Synthetic oligonucleotide
agggacagtaggtata

SEQ ID NO: 509 - DNA, 16 bp, Artificial sequence
  Synthetic oligonucleotide
tattttaaacgggtca

SEQ ID NO: 510 - DNA, 16 bp, Artificial sequence
  Synthetic oligonucleotide
tcggttaaaaataggt

SEQ ID NO: 511 - DNA, 16 bp, Artificial sequence
  Synthetic oligonucleotide
atcaccggaattcgat

SEQ ID NO: 512 - DNA, 16 bp, Artificial sequence
  Synthetic oligonucleotide
caatgcctaccgcaca

SEQ ID NO: 513 - DNA, 16 bp, Artificial sequence
  Synthetic oligonucleotide
taacctattgactata

SEQ ID NO: 514 - DNA, 16 bp, Artificial sequence
  Synthetic oligonucleotide
tcatctcaacctccgt

SEQ ID NO: 515 - DNA, 16 bp, Artificial sequence
  Synthetic oligonucleotide
tttaaaagatcgcctt

SEQ ID NO: 516 - DNA, 16 bp, Artificial sequence
  Synthetic oligonucleotide
taactaggctttaaat

SEQ ID NO: 517 - DNA, 16 bp, Artificial sequence
  Synthetic oligonucleotide
ctatctgaaactcttg

SEQ ID NO: 518 - DNA, 16 bp, Artificial sequence
  Synthetic oligonucleotide
ctaaattggttctggt

SEQ ID NO: 519 - DNA, 16 bp, Artificial sequence
  Synthetic oligonucleotide
ttcaaactaagctact

SEQ ID NO: 520 - DNA, 16 bp, Artificial sequence
  Synthetic oligonucleotide
cattaagttggtaatt

SEQ ID NO: 521 - DNA, 16 bp, Artificial sequence
  Synthetic oligonucleotide
ctagattcactgaatc

SEQ ID NO: 522 - DNA, 16 bp, Artificial sequence
  Synthetic oligonucleotide
tcgcactggctcctgg

SEQ ID NO: 523 - DNA, 16 bp, Artificial sequence
  Synthetic oligonucleotide
cgcctgctaccttcat

SEQ ID NO: 524 - DNA, 16 bp, Artificial sequence
  Synthetic oligonucleotide
gtggccttggcacact

SEQ ID NO: 525 - DNA, 16 bp, Artificial sequence
  Synthetic oligonucleotide
cataagtaagttccag

SEQ ID NO: 526 - DNA, 16 bp, Artificial sequence
  Synthetic oligonucleotide
aatccctttacacctc

SEQ ID NO: 527 - DNA, 16 bp, Artificial sequence
  Synthetic oligonucleotide
cttcagacaagattca

SEQ ID NO: 528 - DNA, 16 bp, Artificial sequence
  Synthetic oligonucleotide
cattaccccaactaaa

SEQ ID NO: 529 - DNA, 16 bp, Artificial sequence
  Synthetic oligonucleotide
actcccccccgcctca

SEQ ID NO: 530 - DNA, 16 bp, Artificial sequence
  Synthetic oligonucleotide
gttacaccttgagtca

SEQ ID NO: 531 - DNA, 16 bp, Artificial sequence
  Synthetic oligonucleotide
tctccaatggacatct

SEQ ID NO: 532 - DNA, 16 bp, Artificial sequence
  Synthetic oligonucleotide
gtcaatagtactatag

SEQ ID NO: 533 - DNA, 16 bp, Artificial sequence
  Synthetic oligonucleotide
ggaatactcttccaag

SEQ ID NO: 534 - DNA, 16 bp, Artificial sequence
  Synthetic oligonucleotide
caatatttgcccctcc

SEQ ID NO: 535 - DNA, 16 bp, Artificial sequence
  Synthetic oligonucleotide
gtttatctgcaatcat

SEQ ID NO: 536 - DNA, 16 bp, Artificial sequence
  Synthetic oligonucleotide
tttaacttcccccagc

SEQ ID NO: 537 - DNA, 16 bp, Artificial sequence
  Synthetic oligonucleotide
ccagttcaatactttc

SEQ ID NO: 538 - DNA, 16 bp, Artificial sequence
  Synthetic oligonucleotide
ccacacactaccatat

SEQ ID NO: 539 - DNA, 16 bp, Artificial sequence
  Synthetic oligonucleotide
tgcagttaaacaatgg

SEQ ID NO: 540 - DNA, 16 bp, Artificial sequence
  Synthetic oligonucleotide
gcccaccctctaagag

SEQ ID NO: 541 - DNA, 16 bp, Artificial sequence
  Synthetic oligonucleotide
tgcctttacttatcaa

SEQ ID NO: 542 - DNA, 16 bp, Artificial sequence
  Synthetic oligonucleotide
cagtagtaagaatctc

SEQ ID NO: 543 - DNA, 16 bp, Artificial sequence
  Synthetic oligonucleotide
gcttgacaagcaatta

SEQ ID NO: 544 - DNA, 16 bp, Artificial sequence
  Synthetic oligonucleotide
ttattccaggattaat

SEQ ID NO: 545 - DNA, 16 bp, Artificial sequence
  Synthetic oligonucleotide
ctgtctgaggcaaacg

SEQ ID NO: 546 - DNA, 16 bp, Artificial sequence
  Synthetic oligonucleotide
gcaagttaaacttatc

SEQ ID NO: 547 - DNA, 16 bp, Artificial sequence
  Synthetic oligonucleotide
gccatggttgatattt

SEQ ID NO: 548 - DNA, 16 bp, Artificial sequence
  Synthetic oligonucleotide
cccacaggaacaagtc

SEQ ID NO: 549 - DNA, 16 bp, Artificial sequence
  Synthetic oligonucleotide
ctacagacaaacacta

SEQ ID NO: 550 - DNA, 16 bp, Artificial sequence
  Synthetic oligonucleotide
cattaaagagtgttcg

SEQ ID NO: 551 - DNA, 16 bp, Artificial sequence
  Synthetic oligonucleotide
tatttagagggcctct

SEQ ID NO: 552 - DNA, 16 bp, Artificial sequence
  Synthetic oligonucleotide
aatttatagacccctg

SEQ ID NO: 553 - DNA, 16 bp, Artificial sequence
  Synthetic oligonucleotide
gtaaaacattgcctac

SEQ ID NO: 554 - DNA, 16 bp, Artificial sequence
  Synthetic oligonucleotide
ccaagcactcatatgc

SEQ ID NO: 555 - DNA, 16 bp, Artificial sequence
  Synthetic oligonucleotide
tacaacaagtaagccc

SEQ ID NO: 556 - DNA, 16 bp, Artificial sequence
  Synthetic oligonucleotide
ttctaatagcagcggg

SEQ ID NO: 557 - DNA, 16 bp, Artificial sequence
  Synthetic oligonucleotide
actcagcctttatcac

SEQ ID NO: 558 - DNA, 16 bp, Artificial sequence
  Synthetic oligonucleotide
gaatgtttcttgtcac

SEQ ID NO: 559 - DNA, 16 bp, Artificial sequence
  Synthetic oligonucleotide
ctgaaagaactagtgg

SEQ ID NO: 560 - DNA, 16 bp, Artificial sequence
  Synthetic oligonucleotide
taactgatctgacttt

SEQ ID NO: 561 - DNA, 16 bp, Artificial sequence
  Synthetic oligonucleotide
acccccacgccaacac

SEQ ID NO: 562 - DNA, 16 bp, Artificial sequence
  Synthetic oligonucleotide
tgacacttctcttgac

SEQ ID NO: 563 - DNA, 16 bp, Artificial sequence
  Synthetic oligonucleotide
gctagggaaaagtggt

SEQ ID NO: 564 - DNA, 16 bp, Artificial sequence
  Synthetic oligonucleotide
caaggatccaagctac

SEQ ID NO: 565 - DNA, 16 bp, Artificial sequence
  Synthetic oligonucleotide
caccaaagacctcgac

SEQ ID NO: 566 - DNA, 16 bp, Artificial sequence
  Synthetic oligonucleotide
ctacttagctgtggtt

SEQ ID NO: 567 - DNA, 16 bp, Artificial sequence
  Synthetic oligonucleotide
cccacccagcattaca

SEQ ID NO: 568 - DNA, 16 bp, Artificial sequence
  Synthetic oligonucleotide
tctgttatgttcacct

SEQ ID NO: 569 - DNA, 16 bp, Artificial sequence
  Synthetic oligonucleotide
tgaccctactgaagag

SEQ ID NO: 570 - DNA, 16 bp, Artificial sequence
  Synthetic oligonucleotide
gacagattagtagtca

SEQ ID NO: 571 - DNA, 16 bp, Artificial sequence
  Synthetic oligonucleotide
atacatcaaggatgta

SEQ ID NO: 572 - DNA, 16 bp, Artificial sequence
  Synthetic oligonucleotide
agaagtctcgggctgc

SEQ ID NO: 573 - DNA, 16 bp, Artificial sequence
  Synthetic oligonucleotide
taagatagcagcacaa

SEQ ID NO: 574 - DNA, 16 bp, Artificial sequence
  Synthetic oligonucleotide
gaccaaactgcagagt

SEQ ID NO: 575 - DNA, 16 bp, Artificial sequence
  Synthetic oligonucleotide
gcagattctgtgttat

SEQ ID NO: 576 - DNA, 16 bp, Artificial sequence
  Synthetic oligonucleotide
ttaaagtagaccaact

SEQ ID NO: 577 - DNA, 16 bp, Artificial sequence
  Synthetic oligonucleotide
aagtgctcacaaggca

SEQ ID NO: 578 - DNA, 16 bp, Artificial sequence
  Synthetic oligonucleotide
gcggccccccagttgc

SEQ ID NO: 579 - DNA, 16 bp, Artificial sequence
  Synthetic oligonucleotide
agcacgggctgtctgc

SEQ ID NO: 580 - DNA, 16 bp, Artificial sequence
  Synthetic oligonucleotide
gcggactttctccccc

SEQ ID NO: 581 - DNA, 16 bp, Artificial sequence
  Synthetic oligonucleotide
actttccattacgcaa

SEQ ID NO: 582 - DNA, 16 bp, Artificial sequence
  Synthetic oligonucleotide
gagggacagtaggtat

SEQ ID NO: 583 - DNA, 16 bp, Artificial sequence
  Synthetic oligonucleotide
atattttaaacgggtc

SEQ ID NO: 584 - DNA, 16 bp, Artificial sequence
  Synthetic oligonucleotide
ttcggttaaaaatagg

SEQ ID NO: 585 - DNA, 16 bp, Artificial sequence
  Synthetic oligonucleotide
catcaccggaattcga

SEQ ID NO: 586 - DNA, 16 bp, Artificial sequence
  Synthetic oligonucleotide
tcaatgcctaccgcac

SEQ ID NO: 587 - DNA, 16 bp, Artificial sequence
  Synthetic oligonucleotide
gtaacctattgactat

SEQ ID NO: 588 - DNA, 16 bp, Artificial sequence
  Synthetic oligonucleotide
gaagaagcttcatctc

SEQ ID NO: 589 - DNA, 16 bp, Artificial sequence
  Synthetic oligonucleotide
ttttaaaagatcgcct

SEQ ID NO: 590 - DNA, 16 bp, Artificial sequence
  Synthetic oligonucleotide
gttaactaggctttaa

SEQ ID NO: 591 - DNA, 16 bp, Artificial sequence
  Synthetic oligonucleotide
cttgtcttagcttgtt

SEQ ID NO: 592 - DNA, 16 bp, Artificial sequence
  Synthetic oligonucleotide
tctaaattggttctgg

SEQ ID NO: 593 - DNA, 16 bp, Artificial sequence
  Synthetic oligonucleotide
gaaagtccttcacatt

SEQ ID NO: 594 - DNA, 16 bp, Artificial sequence
  Synthetic oligonucleotide
acattaagttggtaat

SEQ ID NO: 595 - DNA, 16 bp, Artificial sequence
  Synthetic oligonucleotide
gctgtcttcctagatt

SEQ ID NO: 596 - DNA, 16 bp, Artificial sequence
  Synthetic oligonucleotide
aatcgcactggctcct

SEQ ID NO: 597 - DNA, 16 bp, Artificial sequence
  Synthetic oligonucleotide
gccgcctgctaccttc

SEQ ID NO: 598 - DNA, 16 bp, Artificial sequence
  Synthetic oligonucleotide
gctttccctgtggcct

SEQ ID NO: 599 - DNA, 16 bp, Artificial sequence
  Synthetic oligonucleotide
accataagtaagttcc

SEQ ID NO: 600 - DNA, 16 bp, Artificial sequence
  Synthetic oligonucleotide
aaatccctttacacct

SEQ ID NO: 601 - DNA, 16 bp, Artificial sequence
  Synthetic oligonucleotide
gacttggcagtctgcc

SEQ ID NO: 602 - DNA, 16 bp, Artificial sequence
  Synthetic oligonucleotide
tcattaccccaactaa

SEQ ID NO: 603 - DNA, 16 bp, Artificial sequence
  Synthetic oligonucleotide
aactcccccccgcctc

SEQ ID NO: 604 - DNA, 16 bp, Artificial sequence
  Synthetic oligonucleotide
tgttacaccttgagtc

SEQ ID NO: 605 - DNA, 16 bp, Artificial sequence
  Synthetic oligonucleotide
catttctccaatggac

SEQ ID NO: 606 - DNA, 16 bp, Artificial sequence
  Synthetic oligonucleotide
tgtcaatagtactata

SEQ ID NO: 607 - DNA, 16 bp, Artificial sequence
  Synthetic oligonucleotide
gggaatactcttccaa

SEQ ID NO: 608 - DNA, 16 bp, Artificial sequence
  Synthetic oligonucleotide
ccaatatttgcccctc

SEQ ID NO: 609 - DNA, 16 bp, Artificial sequence
  Synthetic oligonucleotide
agtttatctgcaatca

SEQ ID NO: 610 - DNA, 16 bp, Artificial sequence
  Synthetic oligonucleotide
atttaacttcccccag

SEQ ID NO: 611 - DNA, 16 bp, Artificial sequence
  Synthetic oligonucleotide
cccagttcaatacttt

SEQ ID NO: 612 - DNA, 16 bp, Artificial sequence
  Synthetic oligonucleotide
aaccacacactaccat

SEQ ID NO: 613 - DNA, 16 bp, Artificial sequence
  Synthetic oligonucleotide
accttaacatcttgtt

SEQ ID NO: 614 - DNA, 16 bp, Artificial sequence
  Synthetic oligonucleotide
aagcccaccctctaag

SEQ ID NO: 615 - DNA, 16 bp, Artificial sequence
  Synthetic oligonucleotide
ctgcctttacttatca

SEQ ID NO: 616 - DNA, 16 bp, Artificial sequence
  Synthetic oligonucleotide
tcagtagtaagaatct

SEQ ID NO: 617 - DNA, 16 bp, Artificial sequence
  Synthetic oligonucleotide
agcttgacaagcaatt

SEQ ID NO: 618 - DNA, 16 bp, Artificial sequence
  Synthetic oligonucleotide
ttcggcttcttttatt

SEQ ID NO: 619 - DNA, 16 bp, Artificial sequence
  Synthetic oligonucleotide
gatacctgtctgaggc

SEQ ID NO: 620 - DNA, 16 bp, Artificial sequence
  Synthetic oligonucleotide
tgcaagttaaacttat

SEQ ID NO: 621 - DNA, 16 bp, Artificial sequence
  Synthetic oligonucleotide
tgccatggttgatatt

SEQ ID NO: 622 - DNA, 16 bp, Artificial sequence
  Synthetic oligonucleotide
gcccacaggaacaagt

SEQ ID NO: 623 - DNA, 16 bp, Artificial sequence
  Synthetic oligonucleotide
ttccttagttggcatc

SEQ ID NO: 624 - DNA, 16 bp, Artificial sequence
  Synthetic oligonucleotide
cccaacactgaactac

SEQ ID NO: 625 - DNA, 16 bp, Artificial sequence
  Synthetic oligonucleotide
ccattaaagagtgttc

SEQ ID NO: 626 - DNA, 16 bp, Artificial sequence
  Synthetic oligonucleotide
ttatttagagggcctc

SEQ ID NO: 627 - DNA, 16 bp, Artificial sequence
  Synthetic oligonucleotide
caatttatagacccct

SEQ ID NO: 628 - DNA, 16 bp, Artificial sequence
  Synthetic oligonucleotide
tgtaaaacattgccta

SEQ ID NO: 629 - DNA, 16 bp, Artificial sequence
  Synthetic oligonucleotide
gccaagcactcatatg

SEQ ID NO: 630 - DNA, 16 bp, Artificial sequence
  Synthetic oligonucleotide
ctacaacaagtaagcc

SEQ ID NO: 631 - DNA, 16 bp, Artificial sequence
  Synthetic oligonucleotide
attctaatagcagcgg

SEQ ID NO: 632 - DNA, 16 bp, Artificial sequence
  Synthetic oligonucleotide
caacactcagccttta

SEQ ID NO: 633 - DNA, 16 bp, Artificial sequence
  Synthetic oligonucleotide
actgttgcttgtttgg

SEQ ID NO: 634 - DNA, 16 bp, Artificial sequence
  Synthetic oligonucleotide
gaataccatctgaaag

SEQ ID NO: 635 - DNA, 16 bp, Artificial sequence
  Synthetic oligonucleotide
ataactgatctgactt

SEQ ID NO: 636 - DNA, 16 bp, Artificial sequence
  Synthetic oligonucleotide
tccacccccacgccaa

SEQ ID NO: 637 - DNA, 16 bp, Artificial sequence
  Synthetic oligonucleotide
gctgacacttctcttg

SEQ ID NO: 638 - DNA, 16 bp, Artificial sequence
  Synthetic oligonucleotide
atgttaagagaagccc

SEQ ID NO: 639 - DNA, 16 bp, Artificial sequence
  Synthetic oligonucleotide
agctagggaaaagtgg

SEQ ID NO: 640 - DNA, 16 bp, Artificial sequence
  Synthetic oligonucleotide
acaaggatccaagcta

SEQ ID NO: 641 - DNA, 16 bp, Artificial sequence
  Synthetic oligonucleotide
ccaccaaagacctcga

SEQ ID NO: 642 - DNA, 16 bp, Artificial sequence
  Synthetic oligonucleotide
gctacttagctgtggt

SEQ ID NO: 643 - DNA, 16 bp, Artificial sequence
  Synthetic oligonucleotide
tcccacccagcattac

SEQ ID NO: 644 - DNA, 16 bp, Artificial sequence
  Synthetic oligonucleotide
agtctgttatgttcac

SEQ ID NO: 645 - DNA, 16 bp, Artificial sequence
  Synthetic oligonucleotide
atgaccctactgaaga

SEQ ID NO: 646 - DNA, 16 bp, Artificial sequence
  Synthetic oligonucleotide
agacagattagtagtc

SEQ ID NO: 647 - DNA, 16 bp, Artificial sequence
  Synthetic oligonucleotide
ttatacatcaaggatg

SEQ ID NO: 648 - DNA, 16 bp, Artificial sequence
  Synthetic oligonucleotide
agttttcagcagtagg

SEQ ID NO: 649 - DNA, 16 bp, Artificial sequence
  Synthetic oligonucleotide
aaaaaaggcttagcgc

SEQ ID NO: 650 - DNA, 16 bp, Artificial sequence
  Synthetic oligonucleotide
cagaagtctcgggctg

SEQ ID NO: 651 - DNA, 16 bp, Artificial sequence
  Synthetic oligonucleotide
ctaagatagcagcaca

SEQ ID NO: 652 - DNA, 16 bp, Artificial sequence
  Synthetic oligonucleotide
caagaccaaactgcag

SEQ ID NO: 653 - DNA, 16 bp, Artificial sequence
  Synthetic oligonucleotide
ttacactgctctgggt

SEQ ID NO: 654 - DNA, 16 bp, Artificial sequence
  Synthetic oligonucleotide
tttaaagtagaccaac

SEQ ID NO: 655 - DNA, 16 bp, Artificial sequence
  Synthetic oligonucleotide
gaaagtgctcacaagg

SEQ ID NO: 656 - DNA, 16 bp, Artificial sequence
  Synthetic oligonucleotide
tgcggccccccagttg

SEQ ID NO: 657 - DNA, 16 bp, Artificial sequence
  Synthetic oligonucleotide
cagcacgggctgtctg

SEQ ID NO: 658 - DNA, 16 bp, Artificial sequence
  Synthetic oligonucleotide
ggcggactttctcccc

SEQ ID NO: 659 - DNA, 16 bp, Artificial sequence
  Synthetic oligonucleotide
tactttccattacgca

SEQ ID NO: 660 - DNA, 16 bp, Artificial sequence
  Synthetic oligonucleotide
tgagggacagtaggta

SEQ ID NO: 661 - DNA, 16 bp, Artificial sequence
  Synthetic oligonucleotide
catattttaaacgggt

SEQ ID NO: 662 - DNA, 16 bp, Artificial sequence
  Synthetic oligonucleotide
cttcggttaaaaatag

SEQ ID NO: 663 - DNA, 16 bp, Artificial sequence
  Synthetic oligonucleotide
tcgcatcaccggaatt

SEQ ID NO: 664 - DNA, 16 bp, Artificial sequence
  Synthetic oligonucleotide
cctcaatgcctaccgc

SEQ ID NO: 665 - DNA, 16 bp, Artificial sequence
  Synthetic oligonucleotide
agtaacctattgacta

SEQ ID NO: 666 - DNA, 16 bp, Artificial sequence
  Synthetic oligonucleotide
ctccatgaagaagctt

SEQ ID NO: 667 - DNA, 16 bp, Artificial sequence
  Synthetic oligonucleotide
ctttttaaaagatcgc

SEQ ID NO: 668 - DNA, 16 bp, Artificial sequence
  Synthetic oligonucleotide
cgttaactaggcttta

SEQ ID NO: 669 - DNA, 16 bp, Artificial sequence
  Synthetic oligonucleotide
tacttgtcttagcttg

SEQ ID NO: 670 - DNA, 16 bp, Artificial sequence
  Synthetic oligonucleotide
tcttctaaattggttc

SEQ ID NO: 671 - DNA, 16 bp, Artificial sequence
  Synthetic oligonucleotide
acgaaagtccttcaca

SEQ ID NO: 672 - DNA, 16 bp, Artificial sequence
  Synthetic oligonucleotide
gtccaatgcaaaaaca

SEQ ID NO: 673 - DNA, 16 bp, Artificial sequence
  Synthetic oligonucleotide
gaatcctgtctgctgc

SEQ ID NO: 674 - DNA, 16 bp, Artificial sequence
  Synthetic oligonucleotide
aaatcgcactggctcc

SEQ ID NO: 675 - DNA, 16 bp, Artificial sequence
  Synthetic oligonucleotide
aagccgcctgctacct

SEQ ID NO: 676 - DNA, 16 bp, Artificial sequence
  Synthetic oligonucleotide
cgctttccctgtggcc

SEQ ID NO: 677 - DNA, 16 bp, Artificial sequence
  Synthetic oligonucleotide
taccataagtaagttc

SEQ ID NO: 678 - DNA, 16 bp, Artificial sequence
  Synthetic oligonucleotide
taaatccctttacacc

SEQ ID NO: 679 - DNA, 16 bp, Artificial sequence
  Synthetic oligonucleotide
ggacttggcagtctgc

SEQ ID NO: 680 - DNA, 16 bp, Artificial sequence
  Synthetic oligonucleotide
ttcattaccccaacta

SEQ ID NO: 681 - DNA, 16 bp, Artificial sequence
  Synthetic oligonucleotide
aaaactcccccccgcc

SEQ ID NO: 682 - DNA, 16 bp, Artificial sequence
  Synthetic oligonucleotide
ctgttacaccttgagt

SEQ ID NO: 683 - DNA, 16 bp, Artificial sequence
  Synthetic oligonucleotide
actaccagccatttct

SEQ ID NO: 684 - DNA, 16 bp, Artificial sequence
  Synthetic oligonucleotide
agtttgtcaatagtac

SEQ ID NO: 685 - DNA, 16 bp, Artificial sequence
  Synthetic oligonucleotide
tgggaatactcttcca

SEQ ID NO: 686 - DNA, 16 bp, Artificial sequence
  Synthetic oligonucleotide
tgccaatatttgcccc

SEQ ID NO: 687 - DNA, 16 bp, Artificial sequence
  Synthetic oligonucleotide
catgagtttatctgca

SEQ ID NO: 688 - DNA, 16 bp, Artificial sequence
  Synthetic oligonucleotide
atatttaacttccccc

SEQ ID NO: 689 - DNA, 16 bp, Artificial sequence
  Synthetic oligonucleotide
ccccagttcaatactt

SEQ ID NO: 690 - DNA, 16 bp, Artificial sequence
  Synthetic oligonucleotide
agaaccacacactacc

SEQ ID NO: 691 - DNA, 16 bp, Artificial sequence
  Synthetic oligonucleotide
taccttaacatcttgt

SEQ ID NO: 692 - DNA, 16 bp, Artificial sequence
  Synthetic oligonucleotide
aaagcccaccctctaa

SEQ ID NO: 693 - DNA, 16 bp, Artificial sequence
  Synthetic oligonucleotide
gtatgacatataatct

SEQ ID NO: 694 - DNA, 16 bp, Artificial sequence
  Synthetic oligonucleotide
atcagtagtaagaatc

SEQ ID NO: 695 - DNA, 16 bp, Artificial sequence
  Synthetic oligonucleotide
tagcttgacaagcaat

SEQ ID NO: 696 - DNA, 16 bp, Artificial sequence
  Synthetic oligonucleotide
atttcggcttctttta

SEQ ID NO: 697 - DNA, 16 bp, Artificial sequence
  Synthetic oligonucleotide
agatacctgtctgagg

SEQ ID NO: 698 - DNA, 16 bp, Artificial sequence
  Synthetic oligonucleotide
cagatgcaagttaaac

SEQ ID NO: 699 - DNA, 16 bp, Artificial sequence
  Synthetic oligonucleotide
gaaagtgccatggttg

SEQ ID NO: 700 - DNA, 16 bp, Artificial sequence
  Synthetic oligonucleotide
tcccatcactgaagcc

SEQ ID NO: 701 - DNA, 16 bp, Artificial sequence
  Synthetic oligonucleotide
atttccttagttggca

SEQ ID NO: 702 - DNA, 16 bp, Artificial sequence
  Synthetic oligonucleotide
gccccaacactgaact

SEQ ID NO: 703 - DNA, 16 bp, Artificial sequence
  Synthetic oligonucleotide
tccattaaagagtgtt

SEQ ID NO: 704 - DNA, 16 bp, Artificial sequence
  Synthetic oligonucleotide
cttatttagagggcct

SEQ ID NO: 705 - DNA, 16 bp, Artificial sequence
  Synthetic oligonucleotide
tcaatttatagacccc

SEQ ID NO: 706 - DNA, 16 bp, Artificial sequence
  Synthetic oligonucleotide
gtgtaaaacattgcct

SEQ ID NO: 707 - DNA, 16 bp, Artificial sequence
  Synthetic oligonucleotide
agccaagcactcatat

SEQ ID NO: 708 - DNA, 16 bp, Artificial sequence
  Synthetic oligonucleotide
gctacaacaagtaagc

SEQ ID NO: 709 - DNA, 16 bp, Artificial sequence
  Synthetic oligonucleotide
cattctaatagcagcg

SEQ ID NO: 710 - DNA, 16 bp, Artificial sequence
  Synthetic oligonucleotide
gactgcttaaaactgc

SEQ ID NO: 711 - DNA, 16 bp, Artificial sequence
  Synthetic oligonucleotide
agactgttgcttgttt

SEQ ID NO: 712 - DNA, 16 bp, Artificial sequence
  Synthetic oligonucleotide
gaagaataccatctga

SEQ ID NO: 713 - DNA, 16 bp, Artificial sequence
  Synthetic oligonucleotide
cataactgatctgact

SEQ ID NO: 714 - DNA, 16 bp, Artificial sequence
  Synthetic oligonucleotide
ggctgacacttctctt

SEQ ID NO: 715 - DNA, 16 bp, Artificial sequence
  Synthetic oligonucleotide
ttaagagctgctataa

SEQ ID NO: 716 - DNA, 16 bp, Artificial sequence
  Synthetic oligonucleotide
ctggaaaagctaggga

SEQ ID NO: 717 - DNA, 16 bp, Artificial sequence
  Synthetic oligonucleotide
cacaaggatccaagct

SEQ ID NO: 718 - DNA, 16 bp, Artificial sequence
  Synthetic oligonucleotide
cccaccaaagacctcg

SEQ ID NO: 719 - DNA, 16 bp, Artificial sequence
  Synthetic oligonucleotide
agctacttagctgtgg

SEQ ID NO: 720 - DNA, 16 bp, Artificial sequence
  Synthetic oligonucleotide
tacatgttcccaccca

SEQ ID NO: 721 - DNA, 16 bp, Artificial sequence
  Synthetic oligonucleotide
ggccaagtctgttatg

SEQ ID NO: 722 - DNA, 16 bp, Artificial sequence
  Synthetic oligonucleotide
catgaccctactgaag

SEQ ID NO: 723 - DNA, 16 bp, Artificial sequence
  Synthetic oligonucleotide
cctgaagacagattag

SEQ ID NO: 724 - DNA, 16 bp, Artificial sequence
  Synthetic oligonucleotide
attatacatcaaggat

SEQ ID NO: 725 - DNA, 16 bp, Artificial sequence
  Synthetic oligonucleotide
aagttttcagcagtag

SEQ ID NO: 726 - DNA, 16 bp, Artificial sequence
  Synthetic oligonucleotide
ccttatttagagggcc

SEQ ID NO: 727 - DNA, 16 bp, Artificial sequence
  Synthetic oligonucleotide
acagaagtctcgggct

SEQ ID NO: 728 - DNA, 16 bp, Artificial sequence
  Synthetic oligonucleotide
gctaagatagcagcac

SEQ ID NO: 729 - DNA, 16 bp, Artificial sequence
  Synthetic oligonucleotide
ccccaagaccaaactg

SEQ ID NO: 730 - DNA, 16 bp, Artificial sequence
  Synthetic oligonucleotide
gtgtttacactgctct

SEQ ID NO: 731 - DNA, 16 bp, Artificial sequence
  Synthetic oligonucleotide
ccttttaaagtagacc

SEQ ID NO: 732 - DNA, 16 bp, Artificial sequence
  Synthetic oligonucleotide
tcctgaaagtgctcac

SEQ ID NO: 733 - DNA, 16 bp, Artificial sequence
  Synthetic oligonucleotide
ctgcggccccccagtt

SEQ ID NO: 734 - DNA, 16 bp, Artificial sequence
  Synthetic oligonucleotide
agcagcacgggctgtc

SEQ ID NO: 735 - DNA, 16 bp, Artificial sequence
  Synthetic oligonucleotide
tggcggactttctccc

SEQ ID NO: 736 - DNA, 16 bp, Artificial sequence
  Synthetic oligonucleotide
ttactttccattacgc

SEQ ID NO: 737 - DNA, 16 bp, Artificial sequence
  Synthetic oligonucleotide
ttgagggacagtaggt

SEQ ID NO: 738 - DNA, 16 bp, Artificial sequence
  Synthetic oligonucleotide
tcatattttaaacggg

SEQ ID NO: 739 - DNA, 16 bp, Artificial sequence
  Synthetic oligonucleotide
tcttcggttaaaaata

SEQ ID NO: 740 - DNA, 16 bp, Artificial sequence
  Synthetic oligonucleotide
ctcgcatcaccggaat

SEQ ID NO: 741 - DNA, 16 bp, Artificial sequence
  Synthetic oligonucleotide
gcctcaatgcctaccg

SEQ ID NO: 742 - DNA, 16 bp, Artificial sequence
  Synthetic oligonucleotide
tagtaacctattgact

SEQ ID NO: 743 - DNA, 16 bp, Artificial sequence
  Synthetic oligonucleotide
tactccatgaagaagc

SEQ ID NO: 744 - DNA, 16 bp, Artificial sequence
  Synthetic oligonucleotide
cggtttaatctctttt

SEQ ID NO: 745 - DNA, 16 bp, Artificial sequence
  Synthetic oligonucleotide
cccaattaatctttcc

SEQ ID NO: 746 - DNA, 16 bp, Artificial sequence
  Synthetic oligonucleotide
atacttgtcttagctt

SEQ ID NO: 747 - DNA, 16 bp, Artificial sequence
  Synthetic oligonucleotide
ttctagcttcaagtat

SEQ ID NO: 748 - DNA, 16 bp, Artificial sequence
  Synthetic oligonucleotide
tacgaaagtccttcac

SEQ ID NO: 749 - DNA, 16 bp, Artificial sequence
  Synthetic oligonucleotide
agtccaatgcaaaaac

SEQ ID NO: 750 - DNA, 16 bp, Artificial sequence
  Synthetic oligonucleotide
tggaatcctgtctgct

SEQ ID NO: 751 - DNA, 16 bp, Artificial sequence
  Synthetic oligonucleotide
ccaaatcgcactggct

SEQ ID NO: 752 - DNA, 16 bp, Artificial sequence
  Synthetic oligonucleotide
gccaagccgcctgcta

SEQ ID NO: 753 - DNA, 16 bp, Artificial sequence
  Synthetic oligonucleotide
ctcgctttccctgtgg

SEQ ID NO: 754 - DNA, 16 bp, Artificial sequence
  Synthetic oligonucleotide
ttaccataagtaagtt

SEQ ID NO: 755 - DNA, 16 bp, Artificial sequence
  Synthetic oligonucleotide
ccccatataaatccct

SEQ ID NO: 756 - DNA, 16 bp, Artificial sequence
  Synthetic oligonucleotide
aggacttggcagtctg

SEQ ID NO: 757 - DNA, 16 bp, Artificial sequence
  Synthetic oligonucleotide
cttcattaccccaact

SEQ ID NO: 758 - DNA, 16 bp, Artificial sequence
  Synthetic oligonucleotide
gaaaactcccccccgc

SEQ ID NO: 759 - DNA, 16 bp, Artificial sequence
  Synthetic oligonucleotide
tctgttacaccttgag

SEQ ID NO: 760 - DNA, 16 bp, Artificial sequence
  Synthetic oligonucleotide
taactaccagccattt

SEQ ID NO: 761 - DNA, 16 bp, Artificial sequence
  Synthetic oligonucleotide
cagtttgtcaatagta

SEQ ID NO: 762 - DNA, 16 bp, Artificial sequence
  Synthetic oligonucleotide
actgggaatactcttc

SEQ ID NO: 763 - DNA, 16 bp, Artificial sequence
  Synthetic oligonucleotide
ccaactaattgccaat

SEQ ID NO: 764 - DNA, 16 bp, Artificial sequence
  Synthetic oligonucleotide
ctggcatgagtttatc

SEQ ID NO: 765 - DNA, 16 bp, Artificial sequence
  Synthetic oligonucleotide
catatttaacttcccc

SEQ ID NO: 766 - DNA, 16 bp, Artificial sequence
  Synthetic oligonucleotide
aacccccagttcaata

SEQ ID NO: 767 - DNA, 16 bp, Artificial sequence
  Synthetic oligonucleotide
agagaaccacacacta

SEQ ID NO: 768 - DNA, 16 bp, Artificial sequence
  Synthetic oligonucleotide
ataccttaacatcttg

SEQ ID NO: 769 - DNA, 16 bp, Artificial sequence
  Synthetic oligonucleotide
atcaacaaaagcccac

SEQ ID NO: 770 - DNA, 16 bp, Artificial sequence
  Synthetic oligonucleotide
aggtatgacatataat

SEQ ID NO: 771 - DNA, 16 bp, Artificial sequence
  Synthetic oligonucleotide
catcagtagtaagaat

SEQ ID NO: 772 - DNA, 16 bp, Artificial sequence
  Synthetic oligonucleotide
tatagcttgacaagca

SEQ ID NO: 773 - DNA, 16 bp, Artificial sequence
  Synthetic oligonucleotide
tatttcggcttctttt

SEQ ID NO: 774 - DNA, 16 bp, Artificial sequence
  Synthetic oligonucleotide
gagatacctgtctgag

SEQ ID NO: 775 - DNA, 16 bp, Artificial sequence
  Synthetic oligonucleotide
tgcagatgcaagttaa

SEQ ID NO: 776 - DNA, 16 bp, Artificial sequence
  Synthetic oligonucleotide
gagaaagtgccatggt

SEQ ID NO: 777 - DNA, 16 bp, Artificial sequence
  Synthetic oligonucleotide
atcccatcactgaagc

SEQ ID NO: 778 - DNA, 16 bp, Artificial sequence
  Synthetic oligonucleotide
aatttccttagttggc

SEQ ID NO: 779 - DNA, 16 bp, Artificial sequence
  Synthetic oligonucleotide
ttgccccaacactgaa

SEQ ID NO: 780 - DNA, 16 bp, Artificial sequence
  Synthetic oligonucleotide
gtccattaaagagtgt

SEQ ID NO: 781 - DNA, 16 bp, Artificial sequence
  Synthetic oligonucleotide
gtcaatttatagaccc

SEQ ID NO: 782 - DNA, 16 bp, Artificial sequence
  Synthetic oligonucleotide
agtgtaaaacattgcc

SEQ ID NO: 783 - DNA, 16 bp, Artificial sequence
  Synthetic oligonucleotide
gagccaagcactcata

SEQ ID NO: 784 - DNA, 16 bp, Artificial sequence
  Synthetic oligonucleotide
agctacaacaagtaag

SEQ ID NO: 785 - DNA, 16 bp, Artificial sequence
  Synthetic oligonucleotide
atgcattctaatagca

SEQ ID NO: 786 - DNA, 16 bp, Artificial sequence
  Synthetic oligonucleotide
tacgactgcttaaaac

SEQ ID NO: 787 - DNA, 16 bp, Artificial sequence
  Synthetic oligonucleotide
gaagactgttgcttgt

SEQ ID NO: 788 - DNA, 16 bp, Artificial sequence
  Synthetic oligonucleotide
tgaagaataccatctg

SEQ ID NO: 789 - DNA, 16 bp, Artificial sequence
  Synthetic oligonucleotide
ccataactgatctgac

SEQ ID NO: 790 - DNA, 16 bp, Artificial sequence
  Synthetic oligonucleotide
gtacctgaaaaatctt

SEQ ID NO: 791 - DNA, 16 bp, Artificial sequence
  Synthetic oligonucleotide
gaggctgacacttctc

SEQ ID NO: 792 - DNA, 16 bp, Artificial sequence
  Synthetic oligonucleotide
attaagagctgctata

SEQ ID NO: 793 - DNA, 16 bp, Artificial sequence
  Synthetic oligonucleotide
tctggaaaagctaggg

SEQ ID NO: 794 - DNA, 16 bp, Artificial sequence
  Synthetic oligonucleotide
ccacaaggatccaagc

SEQ ID NO: 795 - DNA, 16 bp, Artificial sequence
  Synthetic oligonucleotide
acccaccaaagacctc

SEQ ID NO: 796 - DNA, 16 bp, Artificial sequence
  Synthetic oligonucleotide
agagctacttagctgt

SEQ ID NO: 797 - DNA, 16 bp, Artificial sequence
  Synthetic oligonucleotide
ttacatgttcccaccc

SEQ ID NO: 798 - DNA, 16 bp, Artificial sequence
  Synthetic oligonucleotide
agcttggccaagtctg

SEQ ID NO: 799 - DNA, 16 bp, Artificial sequence
  Synthetic oligonucleotide
cttcatgaccctactg

SEQ ID NO: 800 - DNA, 16 bp, Artificial sequence
  Synthetic oligonucleotide
tacagaaagagtcctg

SEQ ID NO: 801 - DNA, 16 bp, Artificial sequence
  Synthetic oligonucleotide
tcctgacaaattatac

SEQ ID NO: 802 - DNA, 16 bp, Artificial sequence
  Synthetic oligonucleotide
taagttttcagcagta

SEQ ID NO: 803 - DNA, 16 bp, Artificial sequence
  Synthetic oligonucleotide
gttacatgttcccacc

SEQ ID NO: 804 - DNA, 16 bp, Artificial sequence
  Synthetic oligonucleotide
gagcagcacgggctgt

SEQ ID NO: 805 - DNA, 16 bp, Artificial sequence
  Synthetic oligonucleotide
agccaagccgcctgct

SEQ ID NO: 806 - DNA, 16 bp, Artificial sequence
  Synthetic oligonucleotide
tacagaagtctcgggc

SEQ ID NO: 807 - DNA, 16 bp, Artificial sequence
  Synthetic oligonucleotide
cagctaagatagcagc

SEQ ID NO: 808 - DNA, 16 bp, Artificial sequence
  Synthetic oligonucleotide
aaccccaagaccaaac

SEQ ID NO: 809 - DNA, 16 bp, Artificial sequence
  Synthetic oligonucleotide
agtgtttacactgctc

SEQ ID NO: 810 - DNA, 16 bp, Artificial sequence
  Synthetic oligonucleotide
ggccttttaaagtaga

SEQ ID NO: 811 - DNA, 16 bp, Artificial sequence
  Synthetic oligonucleotide
cgtttttcagcttcca

SEQ ID NO: 812 - DNA, 16 bp, Artificial sequence
  Synthetic oligonucleotide
tctgcggccccccagt

SEQ ID NO: 813 - DNA, 16 bp, Artificial sequence
  Synthetic oligonucleotide
atggcggactttctcc

SEQ ID NO: 814 - DNA, 16 bp, Artificial sequence
  Synthetic oligonucleotide
tttactttccattacg

SEQ ID NO: 815 - DNA, 16 bp, Artificial sequence
  Synthetic oligonucleotide
tcttgagggacagtag

SEQ ID NO: 816 - DNA, 16 bp, Artificial sequence
  Synthetic oligonucleotide
atcatattttaaacgg

SEQ ID NO: 817 - DNA, 16 bp, Artificial sequence
  Synthetic oligonucleotide
ttcttcggttaaaaat

SEQ ID NO: 818 - DNA, 16 bp, Artificial sequence
  Synthetic oligonucleotide
actcgcatcaccggaa

SEQ ID NO: 819 - DNA, 16 bp, Artificial sequence
  Synthetic oligonucleotide
ctgcctcaatgcctac

SEQ ID NO: 820 - DNA, 16 bp, Artificial sequence
  Synthetic oligonucleotide
ttagtaacctattgac

SEQ ID NO: 821 - DNA, 16 bp, Artificial sequence
  Synthetic oligonucleotide
gctctgtagtcctttc

SEQ ID NO: 822 - DNA, 16 bp, Artificial sequence
  Synthetic oligonucleotide
tcggtttaatctcttt

SEQ ID NO: 823 - DNA, 16 bp, Artificial sequence
  Synthetic oligonucleotide
ctcccaattaatcttt

SEQ ID NO: 824 - DNA, 16 bp, Artificial sequence
  Synthetic oligonucleotide
aatacttgtcttagct

SEQ ID NO: 825 - DNA, 16 bp, Artificial sequence
  Synthetic oligonucleotide
cccttctagcttcaag

SEQ ID NO: 826 - DNA, 16 bp, Artificial sequence
  Synthetic oligonucleotide
ttacgaaagtccttca

SEQ ID NO: 827 - DNA, 16 bp, Artificial sequence
  Synthetic oligonucleotide
ctcaaagtccaatgca

SEQ ID NO: 828 - DNA, 16 bp, Artificial sequence
  Synthetic oligonucleotide
acactggttcctggaa

SEQ ID NO: 829 - DNA, 16 bp, Artificial sequence
  Synthetic oligonucleotide
accaaatcgcactggc

SEQ ID NO: 830 - DNA, 16 bp, Artificial sequence
  Synthetic oligonucleotide
actcgctttccctgtg

SEQ ID NO: 831 - DNA, 16 bp, Artificial sequence
  Synthetic oligonucleotide
gttaccataagtaagt

SEQ ID NO: 832 - DNA, 16 bp, Artificial sequence
  Synthetic oligonucleotide
cgtccccatataaatc

SEQ ID NO: 833 - DNA, 16 bp, Artificial sequence
  Synthetic oligonucleotide
caggacttggcagtct

SEQ ID NO: 834 - DNA, 16 bp, Artificial sequence
  Synthetic oligonucleotide
tacttcattaccccaa

SEQ ID NO: 835 - DNA, 16 bp, Artificial sequence
  Synthetic oligonucleotide
tgaaaactcccccccg

SEQ ID NO: 836 - DNA, 16 bp, Artificial sequence
  Synthetic oligonucleotide
ttctgttacaccttga

SEQ ID NO: 837 - DNA, 16 bp, Artificial sequence
  Synthetic oligonucleotide
gtaactaccagccatt

SEQ ID NO: 838 - DNA, 16 bp, Artificial sequence
  Synthetic oligonucleotide
cccagtttgtcaatag

SEQ ID NO: 839 - DNA, 16 bp, Artificial sequence
  Synthetic oligonucleotide
aactgggaatactctt

SEQ ID NO: 840 - DNA, 16 bp, Artificial sequence
  Synthetic oligonucleotide
gccaactaattgccaa

SEQ ID NO: 841 - DNA, 16 bp, Artificial sequence
  Synthetic oligonucleotide
ctttaagttctctggc

SEQ ID NO: 842 - DNA, 16 bp, Artificial sequence
  Synthetic oligonucleotide
ggctcatatttaactt

SEQ ID NO: 843 - DNA, 16 bp, Artificial sequence
  Synthetic oligonucleotide
ccaacccccagttcaa

SEQ ID NO: 844 - DNA, 16 bp, Artificial sequence
  Synthetic oligonucleotide
tccaaaagagaaccac

SEQ ID NO: 845 - DNA, 16 bp, Artificial sequence
  Synthetic oligonucleotide
cataccttaacatctt

SEQ ID NO: 846 - DNA, 16 bp, Artificial sequence
  Synthetic oligonucleotide
tcatcaacaaaagccc

SEQ ID NO: 847 - DNA, 16 bp, Artificial sequence
  Synthetic oligonucleotide
gaggtatgacatataa

SEQ ID NO: 848 - DNA, 16 bp, Artificial sequence
  Synthetic oligonucleotide
tctcatcagtagtaag

SEQ ID NO: 849 - DNA, 16 bp, Artificial sequence
  Synthetic oligonucleotide
ttatagcttgacaagc

SEQ ID NO: 850 - DNA, 16 bp, Artificial sequence
  Synthetic oligonucleotide
atttatttcggcttct

SEQ ID NO: 851 - DNA, 16 bp, Artificial sequence
  Synthetic oligonucleotide
agagatacctgtctga

SEQ ID NO: 852 - DNA, 16 bp, Artificial sequence
  Synthetic oligonucleotide
ctgcagatgcaagtta

SEQ ID NO: 853 - DNA, 16 bp, Artificial sequence
  Synthetic oligonucleotide
ggtcaggagaaagtgc

SEQ ID NO: 854 - DNA, 16 bp, Artificial sequence
  Synthetic oligonucleotide
tactatcccatcactg

SEQ ID NO: 855 - DNA, 16 bp, Artificial sequence
  Synthetic oligonucleotide
aaatttccttagttgg

SEQ ID NO: 856 - DNA, 16 bp, Artificial sequence
  Synthetic oligonucleotide
agattgccccaacact

SEQ ID NO: 857 - DNA, 16 bp, Artificial sequence
  Synthetic oligonucleotide
gatctggtccattaaa

SEQ ID NO: 858 - DNA, 16 bp, Artificial sequence
  Synthetic oligonucleotide
tccttatttagagggc

SEQ ID NO: 859 - DNA, 16 bp, Artificial sequence
  Synthetic oligonucleotide
tgtcaatttatagacc

SEQ ID NO: 860 - DNA, 16 bp, Artificial sequence
  Synthetic oligonucleotide
tagtgtaaaacattgc

SEQ ID NO: 861 - DNA, 16 bp, Artificial sequence
  Synthetic oligonucleotide
aagagccaagcactca

SEQ ID NO: 862 - DNA, 16 bp, Artificial sequence
  Synthetic oligonucleotide
aagctacaacaagtaa

SEQ ID NO: 863 - DNA, 16 bp, Artificial sequence
  Synthetic oligonucleotide
aatgcattctaatagc

SEQ ID NO: 864 - DNA, 16 bp, Artificial sequence
  Synthetic oligonucleotide
atacgactgcttaaaa

SEQ ID NO: 865 - DNA, 16 bp, Artificial sequence
  Synthetic oligonucleotide
cttgaagactgttgct

SEQ ID NO: 866 - DNA, 16 bp, Artificial sequence
  Synthetic oligonucleotide
tctgaagaataccatc

SEQ ID NO: 867 - DNA, 16 bp, Artificial sequence
  Synthetic oligonucleotide
cccataactgatctga

SEQ ID NO: 868 - DNA, 16 bp, Artificial sequence
  Synthetic oligonucleotide
tcggtgcctttagtga

SEQ ID NO: 869 - DNA, 16 bp, Artificial sequence
  Synthetic oligonucleotide
ggtgaggctgacactt

SEQ ID NO: 870 - DNA, 16 bp, Artificial sequence
  Synthetic oligonucleotide
tattaagagctgctat

SEQ ID NO: 871 - DNA, 16 bp, Artificial sequence
  Synthetic oligonucleotide
cttctggaaaagctag

SEQ ID NO: 872 - DNA, 16 bp, Artificial sequence
  Synthetic oligonucleotide
cccacaaggatccaag

SEQ ID NO: 873 - DNA, 16 bp, Artificial sequence
  Synthetic oligonucleotide
caacccaccaaagacc

SEQ ID NO: 874 - DNA, 16 bp, Artificial sequence
  Synthetic oligonucleotide
tagagctacttagctg

SEQ ID NO: 875 - DNA, 16 bp, Artificial sequence
  Synthetic oligonucleotide
tagcttggccaagtct

SEQ ID NO: 876 - DNA, 16 bp, Artificial sequence
  Synthetic oligonucleotide
aaccttcatgacccta

SEQ ID NO: 877 - DNA, 16 bp, Artificial sequence
  Synthetic oligonucleotide
actagcacctgcagag

SEQ ID NO: 878 - DNA, 16 bp, Artificial sequence
  Synthetic oligonucleotide
ctcctgacaaattata

SEQ ID NO: 879 - DNA, 16 bp, Artificial sequence
  Synthetic oligonucleotide
gttaagttttcagcag

SEQ ID NO: 880 - DNA, 16 bp, Artificial sequence
  Synthetic oligonucleotide
gaagagccaagcactc

SEQ ID NO: 881 - DNA, 16 bp, Artificial sequence
  Synthetic oligonucleotide
ttacagaagtctcggg

SEQ ID NO: 882 - DNA, 16 bp, Artificial sequence
  Synthetic oligonucleotide
acagctaagatagcag

SEQ ID NO: 883 - DNA, 16 bp, Artificial sequence
  Synthetic oligonucleotide
ccggagcaggaagaaa

SEQ ID NO: 884 - DNA, 16 bp, Artificial sequence
  Synthetic oligonucleotide
gaagtgtttacactgc

SEQ ID NO: 885 - DNA, 16 bp, Artificial sequence
  Synthetic oligonucleotide
gtggccttttaaagta

SEQ ID NO: 886 - DNA, 16 bp, Artificial sequence
  Synthetic oligonucleotide
ccgtttttcagcttcc

SEQ ID NO: 887 - DNA, 16 bp, Artificial sequence
  Synthetic oligonucleotide
atctgcggccccccag

SEQ ID NO: 888 - DNA, 16 bp, Artificial sequence
  Synthetic oligonucleotide
aatcggagcagcacgg

SEQ ID NO: 889 - DNA, 16 bp, Artificial sequence
  Synthetic oligonucleotide
aatggcggactttctc

SEQ ID NO: 890 - DNA, 16 bp, Artificial sequence
  Synthetic oligonucleotide
gggctttactttccat

SEQ ID NO: 891 - DNA, 16 bp, Artificial sequence
  Synthetic oligonucleotide
ctcttgagggacagta

SEQ ID NO: 892 - DNA, 16 bp, Artificial sequence
  Synthetic oligonucleotide
ctgcaaactttagaca

SEQ ID NO: 893 - DNA, 16 bp, Artificial sequence
  Synthetic oligonucleotide
tagttcttcggttaaa

SEQ ID NO: 894 - DNA, 16 bp, Artificial sequence
  Synthetic oligonucleotide
aactcgcatcaccgga

SEQ ID NO: 895 - DNA, 16 bp, Artificial sequence
  Synthetic oligonucleotide
tgcgctggctgcctca

SEQ ID NO: 896 - DNA, 16 bp, Artificial sequence
  Synthetic oligonucleotide
cttagtaacctattga

SEQ ID NO: 897 - DNA, 16 bp, Artificial sequence
  Synthetic oligonucleotide
attggtattaattcgg

SEQ ID NO: 898 - DNA, 16 bp, Artificial sequence
  Synthetic oligonucleotide
cactcccaattaatct

SEQ ID NO: 899 - DNA, 16 bp, Artificial sequence
  Synthetic oligonucleotide
ccaatacttgtcttag

SEQ ID NO: 900 - DNA, 16 bp, Artificial sequence
  Synthetic oligonucleotide
acttccccttctagct

SEQ ID NO: 901 - DNA, 16 bp, Artificial sequence
  Synthetic oligonucleotide
gttacgaaagtccttc

SEQ ID NO: 902 - DNA, 16 bp, Artificial sequence
  Synthetic oligonucleotide
actcaaagtccaatgc

SEQ ID NO: 903 - DNA, 16 bp, Artificial sequence
  Synthetic oligonucleotide
atcaaacactggttcc

SEQ ID NO: 904 - DNA, 16 bp, Artificial sequence
  Synthetic oligonucleotide
caccaaatcgcactgg

SEQ ID NO: 905 - DNA, 16 bp, Artificial sequence
  Synthetic oligonucleotide
aagccaagccgcctgc

SEQ ID NO: 906 - DNA, 16 bp, Artificial sequence
  Synthetic oligonucleotide
ccactcgctttccctg

SEQ ID NO: 907 - DNA, 16 bp, Artificial sequence
  Synthetic oligonucleotide
ggttaccataagtaag

SEQ ID NO: 908 - DNA, 16 bp, Artificial sequence
  Synthetic oligonucleotide
cggaaatcggcctacg

SEQ ID NO: 909 - DNA, 16 bp, Artificial sequence
  Synthetic oligonucleotide
tccaggacttggcagt

SEQ ID NO: 910 - DNA, 16 bp, Artificial sequence
  Synthetic oligonucleotide
atacttcattacccca

SEQ ID NO: 911 - DNA, 16 bp, Artificial sequence
  Synthetic oligonucleotide
ctgaaaactccccccc

SEQ ID NO: 912 - DNA, 16 bp, Artificial sequence
  Synthetic oligonucleotide
tatcctgatattggat

SEQ ID NO: 913 - DNA, 16 bp, Artificial sequence
  Synthetic oligonucleotide
agtaactaccagccat

SEQ ID NO: 914 - DNA, 16 bp, Artificial sequence
  Synthetic oligonucleotide
acccagtttgtcaata

SEQ ID NO: 915 - DNA, 16 bp, Artificial sequence
  Synthetic oligonucleotide
caactgggaatactct

SEQ ID NO: 916 - DNA, 16 bp, Artificial sequence
  Synthetic oligonucleotide
tgccaactaattgcca

SEQ ID NO: 917 - DNA, 16 bp, Artificial sequence
  Synthetic oligonucleotide
ctaagactttaagttc

SEQ ID NO: 918 - DNA, 16 bp, Artificial sequence
  Synthetic oligonucleotide
acccagtggctcatat

SEQ ID NO: 919 - DNA, 16 bp, Artificial sequence
  Synthetic oligonucleotide
accaacccccagttca

SEQ ID NO: 920 - DNA, 16 bp, Artificial sequence
  Synthetic oligonucleotide
gcagtttctatagtag

SEQ ID NO: 921 - DNA, 16 bp, Artificial sequence
  Synthetic oligonucleotide
gcataccttaacatct

SEQ ID NO: 922 - DNA, 16 bp, Artificial sequence
  Synthetic oligonucleotide
actcagaagatgttat

SEQ ID NO: 923 - DNA, 16 bp, Artificial sequence
  Synthetic oligonucleotide
ggaggtatgacatata

SEQ ID NO: 924 - DNA, 16 bp, Artificial sequence
  Synthetic oligonucleotide
agataatgttctcatc

SEQ ID NO: 925 - DNA, 16 bp, Artificial sequence
  Synthetic oligonucleotide
gttatagcttgacaag

SEQ ID NO: 926 - DNA, 16 bp, Artificial sequence
  Synthetic oligonucleotide
catttatttcggcttc

SEQ ID NO: 927 - DNA, 16 bp, Artificial sequence
  Synthetic oligonucleotide
aagagatacctgtctg

SEQ ID NO: 928 - DNA, 16 bp, Artificial sequence
  Synthetic oligonucleotide
caatactgcagatgca

SEQ ID NO: 929 - DNA, 16 bp, Artificial sequence
  Synthetic oligonucleotide
aatcccctagggaagg

SEQ ID NO: 930 - DNA, 16 bp, Artificial sequence
  Synthetic oligonucleotide
gtactatcccatcact

SEQ ID NO: 931 - DNA, 16 bp, Artificial sequence
  Synthetic oligonucleotide
gagattcaatgctaaa

SEQ ID NO: 932 - DNA, 16 bp, Artificial sequence
  Synthetic oligonucleotide
caagattgccccaaca

SEQ ID NO: 933 - DNA, 16 bp, Artificial sequence
  Synthetic oligonucleotide
cctgatctggtccatt

SEQ ID NO: 934 - DNA, 16 bp, Artificial sequence
  Synthetic oligonucleotide
ttccttatttagaggg

SEQ ID NO: 935 - DNA, 16 bp, Artificial sequence
  Synthetic oligonucleotide
cactgtcaatttatag

SEQ ID NO: 936 - DNA, 16 bp, Artificial sequence
  Synthetic oligonucleotide
atagtgtaaaacattg

SEQ ID NO: 937 - DNA, 16 bp, Artificial sequence
  Synthetic oligonucleotide
gtcaagacaactgcat

SEQ ID NO: 938 - DNA, 16 bp, Artificial sequence
  Synthetic oligonucleotide
caatgcattctaatag

SEQ ID NO: 939 - DNA, 16 bp, Artificial sequence
  Synthetic oligonucleotide
aatacgactgcttaaa

SEQ ID NO: 940 - DNA, 16 bp, Artificial sequence
  Synthetic oligonucleotide
tcttgaagactgttgc

SEQ ID NO: 941 - DNA, 16 bp, Artificial sequence
  Synthetic oligonucleotide
gtctgaagaataccat

SEQ ID NO: 942 - DNA, 16 bp, Artificial sequence
  Synthetic oligonucleotide
tcccataactgatctg

SEQ ID NO: 943 - DNA, 16 bp, Artificial sequence
  Synthetic oligonucleotide
cttcggtgcctttagt

SEQ ID NO: 944 - DNA, 16 bp, Artificial sequence
  Synthetic oligonucleotide
atcaggtgaggctgac

SEQ ID NO: 945 - DNA, 16 bp, Artificial sequence
  Synthetic oligonucleotide
ttattaagagctgcta

SEQ ID NO: 946 - DNA, 16 bp, Artificial sequence
  Synthetic oligonucleotide
ttaacaggcttctgga

SEQ ID NO: 947 - DNA, 16 bp, Artificial sequence
  Synthetic oligonucleotide
gcccacaaggatccaa

SEQ ID NO: 948 - DNA, 16 bp, Artificial sequence
  Synthetic oligonucleotide
gttcaacccaccaaag

SEQ ID NO: 949 - DNA, 16 bp, Artificial sequence
  Synthetic oligonucleotide
atagagctacttagct

SEQ ID NO: 950 - DNA, 16 bp, Artificial sequence
  Synthetic oligonucleotide
agttacatgttcccac

SEQ ID NO: 951 - DNA, 16 bp, Artificial sequence
  Synthetic oligonucleotide
gctagcttggccaagt

SEQ ID NO: 952 - DNA, 16 bp, Artificial sequence
  Synthetic oligonucleotide
cgtgttgttttctcag

SEQ ID NO: 953 - DNA, 16 bp, Artificial sequence
  Synthetic oligonucleotide
aactagcacctgcaga

SEQ ID NO: 954 - DNA, 16 bp, Artificial sequence
  Synthetic oligonucleotide
gctcctgacaaattat

SEQ ID NO: 955 - DNA, 16 bp, Artificial sequence
  Synthetic oligonucleotide
tagagcttctccattt

SEQ ID NO: 956 - DNA, 16 bp, Artificial sequence
  Synthetic oligonucleotide
tgctagcttggccaag

SEQ ID NO: 957 - DNA, 16 bp, Artificial sequence
  Synthetic oligonucleotide
tttacagaagtctcgg

SEQ ID NO: 958 - DNA, 16 bp, Artificial sequence
  Synthetic oligonucleotide
gacagctaagatagca

SEQ ID NO: 959 - DNA, 16 bp, Artificial sequence
  Synthetic oligonucleotide
accggagcaggaagaa

SEQ ID NO: 960 - DNA, 16 bp, Artificial sequence
  Synthetic oligonucleotide
acccagaagtgtttac

SEQ ID NO: 961 - DNA, 16 bp, Artificial sequence
  Synthetic oligonucleotide
tcaagtggccttttaa

SEQ ID NO: 962 - DNA, 16 bp, Artificial sequence
  Synthetic oligonucleotide
accgtttttcagcttc

SEQ ID NO: 963 - DNA, 16 bp, Artificial sequence
  Synthetic oligonucleotide
tgatctgcggcccccc

SEQ ID NO: 964 - DNA, 16 bp, Artificial sequence
  Synthetic oligonucleotide
aaatcggagcagcacg

SEQ ID NO: 965 - DNA, 16 bp, Artificial sequence
  Synthetic oligonucleotide
aaatggcggactttct

SEQ ID NO: 966 - DNA, 16 bp, Artificial sequence
  Synthetic oligonucleotide
agggctttactttcca

SEQ ID NO: 967 - DNA, 16 bp, Artificial sequence
  Synthetic oligonucleotide
tctcttgagggacagt

SEQ ID NO: 968 - DNA, 16 bp, Artificial sequence
  Synthetic oligonucleotide
gctgcaaactttagac

SEQ ID NO: 969 - DNA, 16 bp, Artificial sequence
  Synthetic oligonucleotide
aagtagttcttcggtt

SEQ ID NO: 970 - DNA, 16 bp, Artificial sequence
  Synthetic oligonucleotide
caactcgcatcaccgg

SEQ ID NO: 971 - DNA, 16 bp, Artificial sequence
  Synthetic oligonucleotide
ctgcgctggctgcctc

SEQ ID NO: 972 - DNA, 16 bp, Artificial sequence
  Synthetic oligonucleotide
tcttagtaacctattg

SEQ ID NO: 973 - DNA, 16 bp, Artificial sequence
  Synthetic oligonucleotide
tattggtattaattcg

SEQ ID NO: 974 - DNA, 16 bp, Artificial sequence
  Synthetic oligonucleotide
cttcggtttaatctct

SEQ ID NO: 975 - DNA, 16 bp, Artificial sequence
  Synthetic oligonucleotide
taccactcccaattaa

SEQ ID NO: 976 - DNA, 16 bp, Artificial sequence
  Synthetic oligonucleotide
tccaatacttgtctta

SEQ ID NO: 977 - DNA, 16 bp, Artificial sequence
  Synthetic oligonucleotide
aaccaacttccccttc

SEQ ID NO: 978 - DNA, 16 bp, Artificial sequence
  Synthetic oligonucleotide
cgttacgaaagtcctt

SEQ ID NO: 979 - DNA, 16 bp, Artificial sequence
  Synthetic oligonucleotide
tcttaactcaaagtcc

SEQ ID NO: 980 - DNA, 16 bp, Artificial sequence
  Synthetic oligonucleotide
catcaaacactggttc

SEQ ID NO: 981 - DNA, 16 bp, Artificial sequence
  Synthetic oligonucleotide
tcaccaaatcgcactg

SEQ ID NO: 982 - DNA, 16 bp, Artificial sequence
  Synthetic oligonucleotide
ccaagccaagccgcct

SEQ ID NO: 983 - DNA, 16 bp, Artificial sequence
  Synthetic oligonucleotide
accactcgctttccct

SEQ ID NO: 984 - DNA, 16 bp, Artificial sequence
  Synthetic oligonucleotide
aggttaccataagtaa

SEQ ID NO: 985 - DNA, 16 bp, Artificial sequence
  Synthetic oligonucleotide
ccggaaatcggcctac

SEQ ID NO: 986 - DNA, 16 bp, Artificial sequence
  Synthetic oligonucleotide
actatttctccaggac

SEQ ID NO: 987 - DNA, 16 bp, Artificial sequence
  Synthetic oligonucleotide
aatacttcattacccc

SEQ ID NO: 988 - DNA, 16 bp, Artificial sequence
  Synthetic oligonucleotide
actgaaaactcccccc

SEQ ID NO: 989 - DNA, 16 bp, Artificial sequence
  Synthetic oligonucleotide
ttatcctgatattgga

SEQ ID NO: 990 - DNA, 16 bp, Artificial sequence
  Synthetic oligonucleotide
gagtaactaccagcca

SEQ ID NO: 991 - DNA, 16 bp, Artificial sequence
  Synthetic oligonucleotide
ctaacccagtttgtca

SEQ ID NO: 992 - DNA, 16 bp, Artificial sequence
  Synthetic oligonucleotide
tcaactgggaatactc

SEQ ID NO: 993 - DNA, 16 bp, Artificial sequence
  Synthetic oligonucleotide
ctgccaactaattgcc

SEQ ID NO: 994 - DNA, 16 bp, Artificial sequence
  Synthetic oligonucleotide
ccattctaagacttta

SEQ ID NO: 995 - DNA, 16 bp, Artificial sequence
  Synthetic oligonucleotide
tacacccagtggctca

SEQ ID NO: 996 - DNA, 16 bp, Artificial sequence
  Synthetic oligonucleotide
gaccaacccccagttc

SEQ ID NO: 997 - DNA, 16 bp, Artificial sequence
  Synthetic oligonucleotide
tgcagtttctatagta

SEQ ID NO: 998 - DNA, 16 bp, Artificial sequence
  Synthetic oligonucleotide
agcataccttaacatc

SEQ ID NO: 999 - DNA, 16 bp, Artificial sequence
  Synthetic oligonucleotide
gttatgactcagaaga

SEQ ID NO: 1000 - DNA, 16 bp, Artificial sequence
  Synthetic oligonucleotide
tggaggtatgacatat

SEQ ID NO: 1001 - DNA, 16 bp, Artificial sequence
  Synthetic oligonucleotide
ctcatttatttcggct

SEQ ID NO: 1002 - DNA, 16 bp, Artificial sequence
  Synthetic oligonucleotide
gaagagatacctgtct

SEQ ID NO: 1003 - DNA, 16 bp, Artificial sequence
  Synthetic oligonucleotide
gcaatactgcagatgc

SEQ ID NO: 1004 - DNA, 16 bp, Artificial sequence
  Synthetic oligonucleotide
aaatcccctagggaag

SEQ ID NO: 1005 - DNA, 16 bp, Artificial sequence
  Synthetic oligonucleotide
tgtactatcccatcac

SEQ ID NO: 1006 - DNA, 16 bp, Artificial sequence
  Synthetic oligonucleotide
agccttcagagattca

SEQ ID NO: 1007 - DNA, 16 bp, Artificial sequence
  Synthetic oligonucleotide
ccaagattgccccaac

SEQ ID NO: 1008 - DNA, 16 bp, Artificial sequence
  Synthetic oligonucleotide
tcctgatctggtccat

SEQ ID NO: 1009 - DNA, 16 bp, Artificial sequence
  Synthetic oligonucleotide
attccttatttagagg

SEQ ID NO: 1010 - DNA, 16 bp, Artificial sequence
  Synthetic oligonucleotide
ctaatcactgtcaatt

SEQ ID NO: 1011 - DNA, 16 bp, Artificial sequence
  Synthetic oligonucleotide
gtcaatagtgtaaaac

SEQ ID NO: 1012 - DNA, 16 bp, Artificial sequence
  Synthetic oligonucleotide
tacactcactagaaca

SEQ ID NO: 1013 - DNA, 16 bp, Artificial sequence
  Synthetic oligonucleotide
tgaagtcaagacaact

SEQ ID NO: 1014 - DNA, 16 bp, Artificial sequence
  Synthetic oligonucleotide
cgtttcacaatgcatt

SEQ ID NO: 1015 - DNA, 16 bp, Artificial sequence
  Synthetic oligonucleotide
aaatacgactgcttaa

SEQ ID NO: 1016 - DNA, 16 bp, Artificial sequence
  Synthetic oligonucleotide
cacttgccagtttaat

SEQ ID NO: 1017 - DNA, 16 bp, Artificial sequence
  Synthetic oligonucleotide
tagtctgaagaatacc

SEQ ID NO: 1018 - DNA, 16 bp, Artificial sequence
  Synthetic oligonucleotide
gtcccataactgatct

SEQ ID NO: 1019 - DNA, 16 bp, Artificial sequence
  Synthetic oligonucleotide
ccttcggtgcctttag

SEQ ID NO: 1020 - DNA, 16 bp, Artificial sequence
  Synthetic oligonucleotide
aatcaggtgaggctga

SEQ ID NO: 1021 - DNA, 16 bp, Artificial sequence
  Synthetic oligonucleotide
tattattaagagctgc

SEQ ID NO: 1022 - DNA, 16 bp, Artificial sequence
  Synthetic oligonucleotide
gcttttaacaggcttc

SEQ ID NO: 1023 - DNA, 16 bp, Artificial sequence
  Synthetic oligonucleotide
atgcccacaaggatcc

SEQ ID NO: 1024 - DNA, 16 bp, Artificial sequence
  Synthetic oligonucleotide
tagttcaacccaccaa

SEQ ID NO: 1025 - DNA, 16 bp, Artificial sequence
  Synthetic oligonucleotide
taatagagctacttag

SEQ ID NO: 1026 - DNA, 16 bp, Artificial sequence
  Synthetic oligonucleotide
aagttacatgttccca

SEQ ID NO: 1027 - DNA, 16 bp, Artificial sequence
  Synthetic oligonucleotide
ctgagaaaacaatacg

SEQ ID NO: 1028 - DNA, 16 bp, Artificial sequence
  Synthetic oligonucleotide
gaactagcacctgcag

SEQ ID NO: 1029 - DNA, 16 bp, Artificial sequence
  Synthetic oligonucleotide
agctcctgacaaatta

SEQ ID NO: 1030 - DNA, 16 bp, Artificial sequence
  Synthetic oligonucleotide
aatttagagcttctcc

SEQ ID NO: 1031 - DNA, 16 bp, Artificial sequence
  Synthetic oligonucleotide
ccgttacgaaagtcct

SEQ ID NO: 1032 - DNA, 16 bp, Artificial sequence
  Synthetic oligonucleotide
gtacacccagtggctc

SEQ ID NO: 1033 - DNA, 16 bp, Artificial sequence
  Synthetic oligonucleotide
ctttacagaagtctcg

SEQ ID NO: 1034 - DNA, 16 bp, Artificial sequence
  Synthetic oligonucleotide
ggacagctaagatagc

SEQ ID NO: 1035 - DNA, 16 bp, Artificial sequence
  Synthetic oligonucleotide
aaccggagcaggaaga

SEQ ID NO: 1036 - DNA, 16 bp, Artificial sequence
  Synthetic oligonucleotide
cacccagaagtgttta

SEQ ID NO: 1037 - DNA, 16 bp, Artificial sequence
  Synthetic oligonucleotide
gttcaagtggcctttt

SEQ ID NO: 1038 - DNA, 16 bp, Artificial sequence
  Synthetic oligonucleotide
taccgtttttcagctt

SEQ ID NO: 1039 - DNA, 16 bp, Artificial sequence
  Synthetic oligonucleotide
tctgatctgcggcccc

SEQ ID NO: 1040 - DNA, 16 bp, Artificial sequence
  Synthetic oligonucleotide
gaaatcggagcagcac

SEQ ID NO: 1041 - DNA, 16 bp, Artificial sequence
  Synthetic oligonucleotide
aaaatggcggactttc

SEQ ID NO: 1042 - DNA, 16 bp, Artificial sequence
  Synthetic oligonucleotide
cagggctttactttcc

SEQ ID NO: 1043 - DNA, 16 bp, Artificial sequence
  Synthetic oligonucleotide
cttgtgttctcttgag

SEQ ID NO: 1044 - DNA, 16 bp, Artificial sequence
  Synthetic oligonucleotide
agctgcaaactttaga

SEQ ID NO: 1045 - DNA, 16 bp, Artificial sequence
  Synthetic oligonucleotide
aaagtagttcttcggt

SEQ ID NO: 1046 - DNA, 16 bp, Artificial sequence
  Synthetic oligonucleotide
acaactcgcatcaccg

SEQ ID NO: 1047 - DNA, 16 bp, Artificial sequence
  Synthetic oligonucleotide
gcccctgcgctggctg

SEQ ID NO: 1048 - DNA, 16 bp, Artificial sequence
  Synthetic oligonucleotide
atcttagtaacctatt

SEQ ID NO: 1049 - DNA, 16 bp, Artificial sequence
  Synthetic oligonucleotide
ctattggtattaattc

SEQ ID NO: 1050 - DNA, 16 bp, Artificial sequence
  Synthetic oligonucleotide
ccttcggtttaatctc

SEQ ID NO: 1051 - DNA, 16 bp, Artificial sequence
  Synthetic oligonucleotide
cctaccactcccaatt

SEQ ID NO: 1052 - DNA, 16 bp, Artificial sequence
  Synthetic oligonucleotide
ctccaatacttgtctt

SEQ ID NO: 1053 - DNA, 16 bp, Artificial sequence
  Synthetic oligonucleotide
taaccaacttcccctt

SEQ ID NO: 1054 - DNA, 16 bp, Artificial sequence
  Synthetic oligonucleotide
atcttaactcaaagtc

SEQ ID NO: 1055 - DNA, 16 bp, Artificial sequence
  Synthetic oligonucleotide
tcatcaaacactggtt

SEQ ID NO: 1056 - DNA, 16 bp, Artificial sequence
  Synthetic oligonucleotide
ttcaccaaatcgcact

SEQ ID NO: 1057 - DNA, 16 bp, Artificial sequence
  Synthetic oligonucleotide
gccaagccaagccgcc

SEQ ID NO: 1058 - DNA, 16 bp, Artificial sequence
  Synthetic oligonucleotide
aaccactcgctttccc

SEQ ID NO: 1059 - DNA, 16 bp, Artificial sequence
  Synthetic oligonucleotide
aaggttaccataagta

SEQ ID NO: 1060 - DNA, 16 bp, Artificial sequence
  Synthetic oligonucleotide
cccggaaatcggccta

SEQ ID NO: 1061 - DNA, 16 bp, Artificial sequence
  Synthetic oligonucleotide
ctactatttctccagg

SEQ ID NO: 1062 - DNA, 16 bp, Artificial sequence
  Synthetic oligonucleotide
aaatacttcattaccc

SEQ ID NO: 1063 - DNA, 16 bp, Artificial sequence
  Synthetic oligonucleotide
tactgaaaactccccc

SEQ ID NO: 1064 - DNA, 16 bp, Artificial sequence
  Synthetic oligonucleotide
attatcctgatattgg

SEQ ID NO: 1065 - DNA, 16 bp, Artificial sequence
  Synthetic oligonucleotide
agagtaactaccagcc

SEQ ID NO: 1066 - DNA, 16 bp, Artificial sequence
  Synthetic oligonucleotide
tctaacccagtttgtc

SEQ ID NO: 1067 - DNA, 16 bp, Artificial sequence
  Synthetic oligonucleotide
ttcaactgggaatact

SEQ ID NO: 1068 - DNA, 16 bp, Artificial sequence
  Synthetic oligonucleotide
cactgccaactaattg

SEQ ID NO: 1069 - DNA, 16 bp, Artificial sequence
  Synthetic oligonucleotide
acttggaagttgatat

SEQ ID NO: 1070 - DNA, 16 bp, Artificial sequence
  Synthetic oligonucleotide
agaccaacccccagtt

SEQ ID NO: 1071 - DNA, 16 bp, Artificial sequence
  Synthetic oligonucleotide
ctgcagtttctatagt

SEQ ID NO: 1072 - DNA, 16 bp, Artificial sequence
  Synthetic oligonucleotide
gaagcataccttaaca

SEQ ID NO: 1073 - DNA, 16 bp, Artificial sequence
  Synthetic oligonucleotide
ggttatgactcagaag

SEQ ID NO: 1074 - DNA, 16 bp, Artificial sequence
  Synthetic oligonucleotide
atggaggtatgacata

SEQ ID NO: 1075 - DNA, 16 bp, Artificial sequence
  Synthetic oligonucleotide
gcatatgcagataatg

SEQ ID NO: 1076 - DNA, 16 bp, Artificial sequence
  Synthetic oligonucleotide
tggttatagcttgaca

SEQ ID NO: 1077 - DNA, 16 bp, Artificial sequence
  Synthetic oligonucleotide
tctcatttatttcggc

SEQ ID NO: 1078 - DNA, 16 bp, Artificial sequence
  Synthetic oligonucleotide
cgaagagatacctgtc

SEQ ID NO: 1079 - DNA, 16 bp, Artificial sequence
  Synthetic oligonucleotide
tgcaatactgcagatg

SEQ ID NO: 1080 - DNA, 16 bp, Artificial sequence
  Synthetic oligonucleotide
gaaatcccctagggaa

SEQ ID NO: 1081 - DNA, 16 bp, Artificial sequence
  Synthetic oligonucleotide
gtgtactatcccatca

SEQ ID NO: 1082 - DNA, 16 bp, Artificial sequence
  Synthetic oligonucleotide
ctttcatagagccttc

SEQ ID NO: 1083 - DNA, 16 bp, Artificial sequence
  Synthetic oligonucleotide
cccaagattgccccaa

SEQ ID NO: 1084 - DNA, 16 bp, Artificial sequence
  Synthetic oligonucleotide
aatcctgatctggtcc

SEQ ID NO: 1085 - DNA, 16 bp, Artificial sequence
  Synthetic oligonucleotide
tgtctaagaggttatt

SEQ ID NO: 1086 - DNA, 16 bp, Artificial sequence
  Synthetic oligonucleotide
tctaatcactgtcaat

SEQ ID NO: 1087 - DNA, 16 bp, Artificial sequence
  Synthetic oligonucleotide
ggtcaatagtgtaaaa

SEQ ID NO: 1088 - DNA, 16 bp, Artificial sequence
  Synthetic oligonucleotide
tcatacactcactaga

SEQ ID NO: 1089 - DNA, 16 bp, Artificial sequence
  Synthetic oligonucleotide
ctgaagtcaagacaac

SEQ ID NO: 1090 - DNA, 16 bp, Artificial sequence
  Synthetic oligonucleotide
aatcatactccagtcg

SEQ ID NO: 1091 - DNA, 16 bp, Artificial sequence
  Synthetic oligonucleotide
acaaatacgactgctt

SEQ ID NO: 1092 - DNA, 16 bp, Artificial sequence
  Synthetic oligonucleotide
ccacttgccagtttaa

SEQ ID NO: 1093 - DNA, 16 bp, Artificial sequence
  Synthetic oligonucleotide
ctatagtctgaagaat

SEQ ID NO: 1094 - DNA, 16 bp, Artificial sequence
  Synthetic oligonucleotide
ctattgtcccataact

SEQ ID NO: 1095 - DNA, 16 bp, Artificial sequence
  Synthetic oligonucleotide
gccttcggtgccttta

SEQ ID NO: 1096 - DNA, 16 bp, Artificial sequence
  Synthetic oligonucleotide
gcaagtcctcattact

SEQ ID NO: 1097 - DNA, 16 bp, Artificial sequence
  Synthetic oligonucleotide
gggctttattattaag

SEQ ID NO: 1098 - DNA, 16 bp, Artificial sequence
  Synthetic oligonucleotide
gggagaccttgctttt

SEQ ID NO: 1099 - DNA, 16 bp, Artificial sequence
  Synthetic oligonucleotide
atggatcatgcccaca

SEQ ID NO: 1100 - DNA, 16 bp, Artificial sequence
  Synthetic oligonucleotide
atagttcaacccacca

SEQ ID NO: 1101 - DNA, 16 bp, Artificial sequence
  Synthetic oligonucleotide
ataatagagctactta

SEQ ID NO: 1102 - DNA, 16 bp, Artificial sequence
  Synthetic oligonucleotide
caagttacatgttccc

SEQ ID NO: 1103 - DNA, 16 bp, Artificial sequence
  Synthetic oligonucleotide
gatgctagcttggcca

SEQ ID NO: 1104 - DNA, 16 bp, Artificial sequence
  Synthetic oligonucleotide
caggagtgccaaccac

SEQ ID NO: 1105 - DNA, 16 bp, Artificial sequence
  Synthetic oligonucleotide
agaactagcacctgca

SEQ ID NO: 1106 - DNA, 16 bp, Artificial sequence
  Synthetic oligonucleotide
gtcaagctcctgacaa

SEQ ID NO: 1107 - DNA, 16 bp, Artificial sequence
  Synthetic oligonucleotide
caatttagagcttctc

SEQ ID NO: 1108 - DNA, 16 bp, Artificial sequence
  Synthetic oligonucleotide
aaatcctgatctggtc

SEQ ID NO: 1109 - DNA, 16 bp, Artificial sequence
  Synthetic oligonucleotide
taatcatactccagtc

SEQ ID NO: 1110 - DNA, 16 bp, Artificial sequence
  Synthetic oligonucleotide
ctgaaatcccctaggg

SEQ ID NO: 1111 - DNA, 16 bp, Artificial sequence
  Synthetic oligonucleotide
gtcctttacagaagtc

SEQ ID NO: 1112 - DNA, 16 bp, Artificial sequence
  Synthetic oligonucleotide
taaggacagctaagat

SEQ ID NO: 1113 - DNA, 16 bp, Artificial sequence
  Synthetic oligonucleotide
gaaccggagcaggaag

SEQ ID NO: 1114 - DNA, 16 bp, Artificial sequence
  Synthetic oligonucleotide
cacacccagaagtgtt

SEQ ID NO: 1115 - DNA, 16 bp, Artificial sequence
  Synthetic oligonucleotide
gagttcaagtggcctt

SEQ ID NO: 1116 - DNA, 16 bp, Artificial sequence
  Synthetic oligonucleotide
tctaccgtttttcagc

SEQ ID NO: 1117 - DNA, 16 bp, Artificial sequence
  Synthetic oligonucleotide
ctctgatctgcggccc

SEQ ID NO: 1118 - DNA, 16 bp, Artificial sequence
  Synthetic oligonucleotide
agaaatcggagcagca

SEQ ID NO: 1119 - DNA, 16 bp, Artificial sequence
  Synthetic oligonucleotide
caaaatggcggacttt

SEQ ID NO: 1120 - DNA, 16 bp, Artificial sequence
  Synthetic oligonucleotide
gatagttcagggcttt

SEQ ID NO: 1121 - DNA, 16 bp, Artificial sequence
  Synthetic oligonucleotide
cttaaagcacttcttg

SEQ ID NO: 1122 - DNA, 16 bp, Artificial sequence
  Synthetic oligonucleotide
gatttgagctgcaaac

SEQ ID NO: 1123 - DNA, 16 bp, Artificial sequence
  Synthetic oligonucleotide
aaaagtagttcttcgg

SEQ ID NO: 1124 - DNA, 16 bp, Artificial sequence
  Synthetic oligonucleotide
aacaactcgcatcacc

SEQ ID NO: 1125 - DNA, 16 bp, Artificial sequence
  Synthetic oligonucleotide
gaagcccctgcgctgg

SEQ ID NO: 1126 - DNA, 16 bp, Artificial sequence
  Synthetic oligonucleotide
tatcttagtaacctat

SEQ ID NO: 1127 - DNA, 16 bp, Artificial sequence
  Synthetic oligonucleotide
cttctattggtattaa

SEQ ID NO: 1128 - DNA, 16 bp, Artificial sequence
  Synthetic oligonucleotide
caccttcggtttaatc

SEQ ID NO: 1129 - DNA, 16 bp, Artificial sequence
  Synthetic oligonucleotide
tcctaccactcccaat

SEQ ID NO: 1130 - DNA, 16 bp, Artificial sequence
  Synthetic oligonucleotide
atacttctccaatact

SEQ ID NO: 1131 - DNA, 16 bp, Artificial sequence
  Synthetic oligonucleotide
ttaaccaacttcccct

SEQ ID NO: 1132 - DNA, 16 bp, Artificial sequence
  Synthetic oligonucleotide
tccgttacgaaagtcc

SEQ ID NO: 1133 - DNA, 16 bp, Artificial sequence
  Synthetic oligonucleotide
gctagtcctcaggatt

SEQ ID NO: 1134 - DNA, 16 bp, Artificial sequence
  Synthetic oligonucleotide
agcttcatcaaacact

SEQ ID NO: 1135 - DNA, 16 bp, Artificial sequence
  Synthetic oligonucleotide
cttcaccaaatcgcac

SEQ ID NO: 1136 - DNA, 16 bp, Artificial sequence
  Synthetic oligonucleotide
tgccaagccaagccgc

SEQ ID NO: 1137 - DNA, 16 bp, Artificial sequence
  Synthetic oligonucleotide
ccaaccactcgctttc

SEQ ID NO: 1138 - DNA, 16 bp, Artificial sequence
  Synthetic oligonucleotide
aaaggttaccataagt

SEQ ID NO: 1139 - DNA, 16 bp, Artificial sequence
  Synthetic oligonucleotide
acccggaaatcggcct

SEQ ID NO: 1140 - DNA, 16 bp, Artificial sequence
  Synthetic oligonucleotide
gccatctactatttct

SEQ ID NO: 1141 - DNA, 16 bp, Artificial sequence
  Synthetic oligonucleotide
ggtcatctattcacaa

SEQ ID NO: 1142 - DNA, 16 bp, Artificial sequence
  Synthetic oligonucleotide
atactgaaaactcccc

SEQ ID NO: 1143 - DNA, 16 bp, Artificial sequence
  Synthetic oligonucleotide
gattatcctgatattg

SEQ ID NO: 1144 - DNA, 16 bp, Artificial sequence
  Synthetic oligonucleotide
aagagtaactaccagc

SEQ ID NO: 1145 - DNA, 16 bp, Artificial sequence
  Synthetic oligonucleotide
ctctaacccagtttgt

SEQ ID NO: 1146 - DNA, 16 bp, Artificial sequence
  Synthetic oligonucleotide
cttcaactgggaatac

SEQ ID NO: 1147 - DNA, 16 bp, Artificial sequence
  Synthetic oligonucleotide
taacaggccactgcca

SEQ ID NO: 1148 - DNA, 16 bp, Artificial sequence
  Synthetic oligonucleotide
aacttggaagttgata

SEQ ID NO: 1149 - DNA, 16 bp, Artificial sequence
  Synthetic oligonucleotide
tggtacacccagtggc

SEQ ID NO: 1150 - DNA, 16 bp, Artificial sequence
  Synthetic oligonucleotide
cagaccaacccccagt

SEQ ID NO: 1151 - DNA, 16 bp, Artificial sequence
  Synthetic oligonucleotide
ctctgcagtttctata

SEQ ID NO: 1152 - DNA, 16 bp, Artificial sequence
  Synthetic oligonucleotide
tgaagcataccttaac

SEQ ID NO: 1153 - DNA, 16 bp, Artificial sequence
  Synthetic oligonucleotide
tggttatgactcagaa

SEQ ID NO: 1154 - DNA, 16 bp, Artificial sequence
  Synthetic oligonucleotide
aatggaggtatgacat

SEQ ID NO: 1155 - DNA, 16 bp, Artificial sequence
  Synthetic oligonucleotide
tggcatatgcagataa

SEQ ID NO: 1156 - DNA, 16 bp, Artificial sequence
  Synthetic oligonucleotide
gtggttatagcttgac

SEQ ID NO: 1157 - DNA, 16 bp, Artificial sequence
  Synthetic oligonucleotide
ctctcatttatttcgg

SEQ ID NO: 1158 - DNA, 16 bp, Artificial sequence
  Synthetic oligonucleotide
acgaagagatacctgt

SEQ ID NO: 1159 - DNA, 16 bp, Artificial sequence
  Synthetic oligonucleotide
atgcaatactgcagat

SEQ ID NO: 1160 - DNA, 16 bp, Artificial sequence
  Synthetic oligonucleotide
agtgtactatcccatc

SEQ ID NO: 1161 - DNA, 16 bp, Artificial sequence
  Synthetic oligonucleotide
cctttcatagagcctt

SEQ ID NO: 1162 - DNA, 16 bp, Artificial sequence
  Synthetic oligonucleotide
cccccaagattgcccc

SEQ ID NO: 1163 - DNA, 16 bp, Artificial sequence
  Synthetic oligonucleotide
ctgtctaagaggttat

SEQ ID NO: 1164 - DNA, 16 bp, Artificial sequence
  Synthetic oligonucleotide
ctctaatcactgtcaa

SEQ ID NO: 1165 - DNA, 16 bp, Artificial sequence
  Synthetic oligonucleotide
aggtcaatagtgtaaa

SEQ ID NO: 1166 - DNA, 16 bp, Artificial sequence
  Synthetic oligonucleotide
ctcatacactcactag

SEQ ID NO: 1167 - DNA, 16 bp, Artificial sequence
  Synthetic oligonucleotide
cctgaagtcaagacaa

SEQ ID NO: 1168 - DNA, 16 bp, Artificial sequence
  Synthetic oligonucleotide
cacaaatacgactgct

SEQ ID NO: 1169 - DNA, 16 bp, Artificial sequence
  Synthetic oligonucleotide
actgaactgtttaaac

SEQ ID NO: 1170 - DNA, 16 bp, Artificial sequence
  Synthetic oligonucleotide
tctatagtctgaagaa

SEQ ID NO: 1171 - DNA, 16 bp, Artificial sequence
  Synthetic oligonucleotide
tactattgtcccataa

SEQ ID NO: 1172 - DNA, 16 bp, Artificial sequence
  Synthetic oligonucleotide
agccttcggtgccttt

SEQ ID NO: 1173 - DNA, 16 bp, Artificial sequence
  Synthetic oligonucleotide
aggcaagtcctcatta

SEQ ID NO: 1174 - DNA, 16 bp, Artificial sequence
  Synthetic oligonucleotide
gatttgggctttatta

SEQ ID NO: 1175 - DNA, 16 bp, Artificial sequence
  Synthetic oligonucleotide
gagaagttgcttgtgg

SEQ ID NO: 1176 - DNA, 16 bp, Artificial sequence
  Synthetic oligonucleotide
tatggatcatgcccac

SEQ ID NO: 1177 - DNA, 16 bp, Artificial sequence
  Synthetic oligonucleotide
catagttcaacccacc

SEQ ID NO: 1178 - DNA, 16 bp, Artificial sequence
  Synthetic oligonucleotide
tataatagagctactt

SEQ ID NO: 1179 - DNA, 16 bp, Artificial sequence
  Synthetic oligonucleotide
acaagttacatgttcc

SEQ ID NO: 1180 - DNA, 16 bp, Artificial sequence
  Synthetic oligonucleotide
aagatgctagcttggc

SEQ ID NO: 1181 - DNA, 16 bp, Artificial sequence
  Synthetic oligonucleotide
ccaggagtgccaacca

SEQ ID NO: 1182 - DNA, 16 bp, Artificial sequence
  Synthetic oligonucleotide
aagaactagcacctgc

SEQ ID NO: 1183 - DNA, 16 bp, Artificial sequence
  Synthetic oligonucleotide
agtcaagctcctgaca

SEQ ID NO: 1184 - DNA, 16 bp, Artificial sequence
  Synthetic oligonucleotide
caacaatttagagctt

SEQ ID NO: 1185 - DNA, 16 bp, Artificial sequence
  Synthetic oligonucleotide
catgcaatactgcaga

SEQ ID NO: 1186 - DNA, 16 bp, Artificial sequence
  Synthetic oligonucleotide
cctgaaatcccctagg

SEQ ID NO: 1187 - DNA, 16 bp, Artificial sequence
  Synthetic oligonucleotide
cagtcctttacagaag

SEQ ID NO: 1188 - DNA, 16 bp, Artificial sequence
  Synthetic oligonucleotide
ataaggacagctaaga

SEQ ID NO: 1189 - DNA, 16 bp, Artificial sequence
  Synthetic oligonucleotide
tgaaccggagcaggaa

SEQ ID NO: 1190 - DNA, 16 bp, Artificial sequence
  Synthetic oligonucleotide
gtcagggacacaccca

SEQ ID NO: 1191 - DNA, 16 bp, Artificial sequence
  Synthetic oligonucleotide
cgagttcaagtggcct

SEQ ID NO: 1192 - DNA, 16 bp, Artificial sequence
  Synthetic oligonucleotide
ttctaccgtttttcag

SEQ ID NO: 1193 - DNA, 16 bp, Artificial sequence
  Synthetic oligonucleotide
actctgatctgcggcc

SEQ ID NO: 1194 - DNA, 16 bp, Artificial sequence
  Synthetic oligonucleotide
gagaaatcggagcagc

SEQ ID NO: 1195 - DNA, 16 bp, Artificial sequence
  Synthetic oligonucleotide
gcaaaatggcggactt

SEQ ID NO: 1196 - DNA, 16 bp, Artificial sequence
  Synthetic oligonucleotide
tgatagttcagggctt

SEQ ID NO: 1197 - DNA, 16 bp, Artificial sequence
  Synthetic oligonucleotide
acctcttaaagcactt

SEQ ID NO: 1198 - DNA, 16 bp, Artificial sequence
  Synthetic oligonucleotide
agatttgagctgcaaa

SEQ ID NO: 1199 - DNA, 16 bp, Artificial sequence
  Synthetic oligonucleotide
aaaaagtagttcttcg

SEQ ID NO: 1200 - DNA, 16 bp, Artificial sequence
  Synthetic oligonucleotide
gaacaactcgcatcac

SEQ ID NO: 1201 - DNA, 16 bp, Artificial sequence
  Synthetic oligonucleotide
cagaagcccctgcgct

SEQ ID NO: 1202 - DNA, 16 bp, Artificial sequence
  Synthetic oligonucleotide
atatcttagtaaccta

SEQ ID NO: 1203 - DNA, 16 bp, Artificial sequence
  Synthetic oligonucleotide
ccttctattggtatta

SEQ ID NO: 1204 - DNA, 16 bp, Artificial sequence
  Synthetic oligonucleotide
tcaccttcggtttaat

SEQ ID NO: 1205 - DNA, 16 bp, Artificial sequence
  Synthetic oligonucleotide
atcctaccactcccaa

SEQ ID NO: 1206 - DNA, 16 bp, Artificial sequence
  Synthetic oligonucleotide
tatacttctccaatac

SEQ ID NO: 1207 - DNA, 16 bp, Artificial sequence
  Synthetic oligonucleotide
gatgtgatttttaacc

SEQ ID NO: 1208 - DNA, 16 bp, Artificial sequence
  Synthetic oligonucleotide
ttccgttacgaaagtc

SEQ ID NO: 1209 - DNA, 16 bp, Artificial sequence
  Synthetic oligonucleotide
tgctagtcctcaggat

SEQ ID NO: 1210 - DNA, 16 bp, Artificial sequence
  Synthetic oligonucleotide
cctagcttcatcaaac

SEQ ID NO: 1211 - DNA, 16 bp, Artificial sequence
  Synthetic oligonucleotide
tccttcaccaaatcgc

SEQ ID NO: 1212 - DNA, 16 bp, Artificial sequence
  Synthetic oligonucleotide
gtgtggttgccaagcc

SEQ ID NO: 1213 - DNA, 16 bp, Artificial sequence
  Synthetic oligonucleotide
taccaaccactcgctt

SEQ ID NO: 1214 - DNA, 16 bp, Artificial sequence
  Synthetic oligonucleotide
cccattatattagaaa

SEQ ID NO: 1215 - DNA, 16 bp, Artificial sequence
  Synthetic oligonucleotide
cacccggaaatcggcc

SEQ ID NO: 1216 - DNA, 16 bp, Artificial sequence
  Synthetic oligonucleotide
tgccatctactatttc

SEQ ID NO: 1217 - DNA, 16 bp, Artificial sequence
  Synthetic oligonucleotide
aggtcatctattcaca

SEQ ID NO: 1218 - DNA, 16 bp, Artificial sequence
  Synthetic oligonucleotide
atattttgcccccacc

SEQ ID NO: 1219 - DNA, 16 bp, Artificial sequence
  Synthetic oligonucleotide
ctgattatcctgatat

SEQ ID NO: 1220 - DNA, 16 bp, Artificial sequence
  Synthetic oligonucleotide
aaagagtaactaccag

SEQ ID NO: 1221 - DNA, 16 bp, Artificial sequence
  Synthetic oligonucleotide
tctctaacccagtttg

SEQ ID NO: 1222 - DNA, 16 bp, Artificial sequence
  Synthetic oligonucleotide
agcttcaactgggaat

SEQ ID NO: 1223 - DNA, 16 bp, Artificial sequence
  Synthetic oligonucleotide
gtaacaggccactgcc

SEQ ID NO: 1224 - DNA, 16 bp, Artificial sequence
  Synthetic oligonucleotide
caacttggaagttgat

SEQ ID NO: 1225 - DNA, 16 bp, Artificial sequence
  Synthetic oligonucleotide
ctggtacacccagtgg

SEQ ID NO: 1226 - DNA, 16 bp, Artificial sequence
  Synthetic oligonucleotide
ggccagaccaaccccc

SEQ ID NO: 1227 - DNA, 16 bp, Artificial sequence
  Synthetic oligonucleotide
tcattaagccacttcc

SEQ ID NO: 1228 - DNA, 16 bp, Artificial sequence
  Synthetic oligonucleotide
ttgaagcataccttaa

SEQ ID NO: 1229 - DNA, 16 bp, Artificial sequence
  Synthetic oligonucleotide
ctggttatgactcaga

SEQ ID NO: 1230 - DNA, 16 bp, Artificial sequence
  Synthetic oligonucleotide
ccaatggaggtatgac

SEQ ID NO: 1231 - DNA, 16 bp, Artificial sequence
  Synthetic oligonucleotide
tttggcatatgcagat

SEQ ID NO: 1232 - DNA, 16 bp, Artificial sequence
  Synthetic oligonucleotide
ttgtggttatagcttg

SEQ ID NO: 1233 - DNA, 16 bp, Artificial sequence
  Synthetic oligonucleotide
tgatcccaactcatct

SEQ ID NO: 1234 - DNA, 16 bp, Artificial sequence
  Synthetic oligonucleotide
aacgaagagatacctg

SEQ ID NO: 1235 - DNA, 16 bp, Artificial sequence
  Synthetic oligonucleotide
aagtgtactatcccat

SEQ ID NO: 1236 - DNA, 16 bp, Artificial sequence
  Synthetic oligonucleotide
tcctttcatagagcct

SEQ ID NO: 1237 - DNA, 16 bp, Artificial sequence
  Synthetic oligonucleotide
ccccccaagattgccc

SEQ ID NO: 1238 - DNA, 16 bp, Artificial sequence
  Synthetic oligonucleotide
caaatcctgatctggt

SEQ ID NO: 1239 - DNA, 16 bp, Artificial sequence
  Synthetic oligonucleotide
cctgtctaagaggtta

SEQ ID NO: 1240 - DNA, 16 bp, Artificial sequence
  Synthetic oligonucleotide
actctaatcactgtca

SEQ ID NO: 1241 - DNA, 16 bp, Artificial sequence
  Synthetic oligonucleotide
taaggtcaatagtgta

SEQ ID NO: 1242 - DNA, 16 bp, Artificial sequence
  Synthetic oligonucleotide
tctcatacactcacta

SEQ ID NO: 1243 - DNA, 16 bp, Artificial sequence
  Synthetic oligonucleotide
gacctgaagtcaagac

SEQ ID NO: 1244 - DNA, 16 bp, Artificial sequence
  Synthetic oligonucleotide
ttaatcatactccagt

SEQ ID NO: 1245 - DNA, 16 bp, Artificial sequence
  Synthetic oligonucleotide
tcacaaatacgactgc

SEQ ID NO: 1246 - DNA, 16 bp, Artificial sequence
  Synthetic oligonucleotide
gcactaaagatcactg

SEQ ID NO: 1247 - DNA, 16 bp, Artificial sequence
  Synthetic oligonucleotide
ttctatagtctgaaga

SEQ ID NO: 1248 - DNA, 16 bp, Artificial sequence
  Synthetic oligonucleotide
atactattgtcccata

SEQ ID NO: 1249 - DNA, 16 bp, Artificial sequence
  Synthetic oligonucleotide
taagccttcggtgcct

SEQ ID NO: 1250 - DNA, 16 bp, Artificial sequence
  Synthetic oligonucleotide
gaggcaagtcctcatt

SEQ ID NO: 1251 - DNA, 16 bp, Artificial sequence
  Synthetic oligonucleotide
gagatttgggctttat

SEQ ID NO: 1252 - DNA, 16 bp, Artificial sequence
  Synthetic oligonucleotide
agagaagttgcttgtg

SEQ ID NO: 1253 - DNA, 16 bp, Artificial sequence
  Synthetic oligonucleotide
ttatggatcatgccca

SEQ ID NO: 1254 - DNA, 16 bp, Artificial sequence
  Synthetic oligonucleotide
acatagttcaacccac

SEQ ID NO: 1255 - DNA, 16 bp, Artificial sequence
  Synthetic oligonucleotide
ttataatagagctact

SEQ ID NO: 1256 - DNA, 16 bp, Artificial sequence
  Synthetic oligonucleotide
tacaagttacatgttc

SEQ ID NO: 1257 - DNA, 16 bp, Artificial sequence
  Synthetic oligonucleotide
taagatgctagcttgg

SEQ ID NO: 1258 - DNA, 16 bp, Artificial sequence
  Synthetic oligonucleotide
accaggagtgccaacc

SEQ ID NO: 1259 - DNA, 16 bp, Artificial sequence
  Synthetic oligonucleotide
caagaactagcacctg

SEQ ID NO: 1260 - DNA, 16 bp, Artificial sequence
  Synthetic oligonucleotide
aagtcaagctcctgac

SEQ ID NO: 1261 - DNA, 16 bp, Artificial sequence
  Synthetic oligonucleotide
acaacaatttagagct

SEQ ID NO: 1262 - DNA, 16 bp, Artificial sequence
  Synthetic oligonucleotide
tttgaagcatacctta

SEQ ID NO: 1263 - DNA, 16 bp, Artificial sequence
  Synthetic oligonucleotide
ccccagtcctttacag

SEQ ID NO: 1264 - DNA, 16 bp, Artificial sequence
  Synthetic oligonucleotide
tataaggacagctaag

SEQ ID NO: 1265 - DNA, 16 bp, Artificial sequence
  Synthetic oligonucleotide
ctgaaccggagcagga

SEQ ID NO: 1266 - DNA, 16 bp, Artificial sequence
  Synthetic oligonucleotide
agtcagggacacaccc

SEQ ID NO: 1267 - DNA, 16 bp, Artificial sequence
  Synthetic oligonucleotide
gcgagttcaagtggcc

SEQ ID NO: 1268 - DNA, 16 bp, Artificial sequence
  Synthetic oligonucleotide
aatttttctaccgttt

SEQ ID NO: 1269 - DNA, 16 bp, Artificial sequence
  Synthetic oligonucleotide
cactctgatctgcggc

SEQ ID NO: 1270 - DNA, 16 bp, Artificial sequence
  Synthetic oligonucleotide
cgagaaatcggagcag

SEQ ID NO: 1271 - DNA, 16 bp, Artificial sequence
  Synthetic oligonucleotide
ggcaaaatggcggact

SEQ ID NO: 1272 - DNA, 16 bp, Artificial sequence
  Synthetic oligonucleotide
tgtgatagttcagggc

SEQ ID NO: 1273 - DNA, 16 bp, Artificial sequence
  Synthetic oligonucleotide
tacctcttaaagcact

SEQ ID NO: 1274 - DNA, 16 bp, Artificial sequence
  Synthetic oligonucleotide
aagatttgagctgcaa

SEQ ID NO: 1275 - DNA, 16 bp, Artificial sequence
  Synthetic oligonucleotide
caaaaagtagttcttc

SEQ ID NO: 1276 - DNA, 16 bp, Artificial sequence
  Synthetic oligonucleotide
agaacaactcgcatca

SEQ ID NO: 1277 - DNA, 16 bp, Artificial sequence
  Synthetic oligonucleotide
agcagaagcccctgcg

SEQ ID NO: 1278 - DNA, 16 bp, Artificial sequence
  Synthetic oligonucleotide
aatatcttagtaacct

SEQ ID NO: 1279 - DNA, 16 bp, Artificial sequence
  Synthetic oligonucleotide
cccttctattggtatt

SEQ ID NO: 1280 - DNA, 16 bp, Artificial sequence
  Synthetic oligonucleotide
atcaccttcggtttaa

SEQ ID NO: 1281 - DNA, 16 bp, Artificial sequence
  Synthetic oligonucleotide
tcatcctaccactccc

SEQ ID NO: 1282 - DNA, 16 bp, Artificial sequence
  Synthetic oligonucleotide
ctatacttctccaata

SEQ ID NO: 1283 - DNA, 16 bp, Artificial sequence
  Synthetic oligonucleotide
tagtagctttttgatg

SEQ ID NO: 1284 - DNA, 16 bp, Artificial sequence
  Synthetic oligonucleotide
acttccgttacgaaag

SEQ ID NO: 1285 - DNA, 16 bp, Artificial sequence
  Synthetic oligonucleotide
atgctagtcctcagga

SEQ ID NO: 1286 - DNA, 16 bp, Artificial sequence
  Synthetic oligonucleotide
tcctagcttcatcaaa

SEQ ID NO: 1287 - DNA, 16 bp, Artificial sequence
  Synthetic oligonucleotide
tagcttccttcaccaa

SEQ ID NO: 1288 - DNA, 16 bp, Artificial sequence
  Synthetic oligonucleotide
cgtgtggttgccaagc

SEQ ID NO: 1289 - DNA, 16 bp, Artificial sequence
  Synthetic oligonucleotide
ttaccaaccactcgct

SEQ ID NO: 1290 - DNA, 16 bp, Artificial sequence
  Synthetic oligonucleotide
ccccattatattagaa

SEQ ID NO: 1291 - DNA, 16 bp, Artificial sequence
  Synthetic oligonucleotide
acacccggaaatcggc

SEQ ID NO: 1292 - DNA, 16 bp, Artificial sequence
  Synthetic oligonucleotide
aacttgccatctacta

SEQ ID NO: 1293 - DNA, 16 bp, Artificial sequence
  Synthetic oligonucleotide
caggtcatctattcac

SEQ ID NO: 1294 - DNA, 16 bp, Artificial sequence
  Synthetic oligonucleotide
catattttgcccccac

SEQ ID NO: 1295 - DNA, 16 bp, Artificial sequence
  Synthetic oligonucleotide
tctgattatcctgata

SEQ ID NO: 1296 - DNA, 16 bp, Artificial sequence
  Synthetic oligonucleotide
taaagtctgattaagg

SEQ ID NO: 1297 - DNA, 16 bp, Artificial sequence
  Synthetic oligonucleotide
cttctctaacccagtt

SEQ ID NO: 1298 - DNA, 16 bp, Artificial sequence
  Synthetic oligonucleotide
ctgcactgtgctgtac

SEQ ID NO: 1299 - DNA, 16 bp, Artificial sequence
  Synthetic oligonucleotide
cgtaacaggccactgc

SEQ ID NO: 1300 - DNA, 16 bp, Artificial sequence
  Synthetic oligonucleotide
ccaacttggaagttga

SEQ ID NO: 1301 - DNA, 16 bp, Artificial sequence
  Synthetic oligonucleotide
actggtacacccagtg

SEQ ID NO: 1302 - DNA, 16 bp, Artificial sequence
  Synthetic oligonucleotide
agtaggccagaccaac

SEQ ID NO: 1303 - DNA, 16 bp, Artificial sequence
  Synthetic oligonucleotide
atcattaagccacttc

SEQ ID NO: 1304 - DNA, 16 bp, Artificial sequence
  Synthetic oligonucleotide
gctggttatgactcag

SEQ ID NO: 1305 - DNA, 16 bp, Artificial sequence
  Synthetic oligonucleotide
cccaatggaggtatga

SEQ ID NO: 1306 - DNA, 16 bp, Artificial sequence
  Synthetic oligonucleotide
tggtagctttcatttg

SEQ ID NO: 1307 - DNA, 16 bp, Artificial sequence
  Synthetic oligonucleotide
tttttgtggttatagc

SEQ ID NO: 1308 - DNA, 16 bp, Artificial sequence
  Synthetic oligonucleotide
ttgatcccaactcatc

SEQ ID NO: 1309 - DNA, 16 bp, Artificial sequence
  Synthetic oligonucleotide
taacgaagagatacct

SEQ ID NO: 1310 - DNA, 16 bp, Artificial sequence
  Synthetic oligonucleotide
acatgcaatactgcag

SEQ ID NO: 1311 - DNA, 16 bp, Artificial sequence
  Synthetic oligonucleotide
tcctgaaatcccctag

SEQ ID NO: 1312 - DNA, 16 bp, Artificial sequence
  Synthetic oligonucleotide
gaagtgtactatccca

SEQ ID NO: 1313 - DNA, 16 bp, Artificial sequence
  Synthetic oligonucleotide
ttcctttcatagagcc

SEQ ID NO: 1314 - DNA, 16 bp, Artificial sequence
  Synthetic oligonucleotide
cccccccaagattgcc

SEQ ID NO: 1315 - DNA, 16 bp, Artificial sequence
  Synthetic oligonucleotide
tcaaatcctgatctgg

SEQ ID NO: 1316 - DNA, 16 bp, Artificial sequence
  Synthetic oligonucleotide
acctgtctaagaggtt

SEQ ID NO: 1317 - DNA, 16 bp, Artificial sequence
  Synthetic oligonucleotide
tactctaatcactgtc

SEQ ID NO: 1318 - DNA, 16 bp, Artificial sequence
  Synthetic oligonucleotide
ataaggtcaatagtgt

SEQ ID NO: 1319 - DNA, 16 bp, Artificial sequence
  Synthetic oligonucleotide
gtctcatacactcact

SEQ ID NO: 1320 - DNA, 16 bp, Artificial sequence
  Synthetic oligonucleotide
cagacctgaagtcaag

SEQ ID NO: 1321 - DNA, 16 bp, Artificial sequence
  Synthetic oligonucleotide
tttaatcatactccag

SEQ ID NO: 1322 - DNA, 16 bp, Artificial sequence
  Synthetic oligonucleotide
atcacaaatacgactg

SEQ ID NO: 1323 - DNA, 16 bp, Artificial sequence
  Synthetic oligonucleotide
tgcactaaagatcact

SEQ ID NO: 1324 - DNA, 16 bp, Artificial sequence
  Synthetic oligonucleotide
cttctatagtctgaag

SEQ ID NO: 1325 - DNA, 16 bp, Artificial sequence
  Synthetic oligonucleotide
caatactattgtccca

SEQ ID NO: 1326 - DNA, 16 bp, Artificial sequence
  Synthetic oligonucleotide
tttaagccttcggtgc

SEQ ID NO: 1327 - DNA, 16 bp, Artificial sequence
  Synthetic oligonucleotide
tgaggcaagtcctcat

SEQ ID NO: 1328 - DNA, 16 bp, Artificial sequence
  Synthetic oligonucleotide
cttgagatttgggctt

SEQ ID NO: 1329 - DNA, 16 bp, Artificial sequence
  Synthetic oligonucleotide
gcagagaagttgcttg

SEQ ID NO: 1330 - DNA, 16 bp, Artificial sequence
  Synthetic oligonucleotide
attatggatcatgccc

SEQ ID NO: 1331 - DNA, 16 bp, Artificial sequence
  Synthetic oligonucleotide
aacatagttcaaccca

SEQ ID NO: 1332 - DNA, 16 bp, Artificial sequence
  Synthetic oligonucleotide
gtattataatagagct

SEQ ID NO: 1333 - DNA, 16 bp, Artificial sequence
  Synthetic oligonucleotide
ctacaagttacatgtt

SEQ ID NO: 1334 - DNA, 16 bp, Artificial sequence
  Synthetic oligonucleotide
ctaagatgctagcttg

SEQ ID NO: 1335 - DNA, 16 bp, Artificial sequence
  Synthetic oligonucleotide
aaccaggagtgccaac

SEQ ID NO: 1336 - DNA, 16 bp, Artificial sequence
  Synthetic oligonucleotide
ccaagaactagcacct

SEQ ID NO: 1337 - DNA, 16 bp, Artificial sequence
  Synthetic oligonucleotide
tcaagtcaagctcctg

SEQ ID NO: 1338 - DNA, 16 bp, Artificial sequence
  Synthetic oligonucleotide
cacaacaatttagagc

SEQ ID NO: 1339 - DNA, 16 bp, Artificial sequence
  Synthetic oligonucleotide
gccccagtcctttaca

SEQ ID NO: 1340 - DNA, 16 bp, Artificial sequence
  Synthetic oligonucleotide
ctataaggacagctaa

SEQ ID NO: 1341 - DNA, 16 bp, Artificial sequence
  Synthetic oligonucleotide
tctgaaccggagcagg

SEQ ID NO: 1342 - DNA, 16 bp, Artificial sequence
  Synthetic oligonucleotide
agccagtcagggacac

SEQ ID NO: 1343 - DNA, 16 bp, Artificial sequence
  Synthetic oligonucleotide
agcgagttcaagtggc

SEQ ID NO: 1344 - DNA, 16 bp, Artificial sequence
  Synthetic oligonucleotide
aaatttttctaccgtt

SEQ ID NO: 1345 - DNA, 16 bp, Artificial sequence
  Synthetic oligonucleotide
gcccactctgatctgc

SEQ ID NO: 1346 - DNA, 16 bp, Artificial sequence
  Synthetic oligonucleotide
ttcgagaaatcggagc

SEQ ID NO: 1347 - DNA, 16 bp, Artificial sequence
  Synthetic oligonucleotide
tggcaaaatggcggac

SEQ ID NO: 1348 - DNA, 16 bp, Artificial sequence
  Synthetic oligonucleotide
gtgtgatagttcaggg

SEQ ID NO: 1349 - DNA, 16 bp, Artificial sequence
  Synthetic oligonucleotide
ccggaacttttaaaat

SEQ ID NO: 1350 - DNA, 16 bp, Artificial sequence
  Synthetic oligonucleotide
aaagatttgagctgca

SEQ ID NO: 1351 - DNA, 16 bp, Artificial sequence
  Synthetic oligonucleotide
ggcaaaaagtagttct

SEQ ID NO: 1352 - DNA, 16 bp, Artificial sequence
  Synthetic oligonucleotide
gagaacaactcgcatc

SEQ ID NO: 1353 - DNA, 16 bp, Artificial sequence
  Synthetic oligonucleotide
gccccctcagcagaag

SEQ ID NO: 1354 - DNA, 16 bp, Artificial sequence
  Synthetic oligonucleotide
caatatcttagtaacc

SEQ ID NO: 1355 - DNA, 16 bp, Artificial sequence
  Synthetic oligonucleotide
gcccttctattggtat

SEQ ID NO: 1356 - DNA, 16 bp, Artificial sequence
  Synthetic oligonucleotide
aatcaccttcggttta

SEQ ID NO: 1357 - DNA, 16 bp, Artificial sequence
  Synthetic oligonucleotide
tttcatcctaccactc

SEQ ID NO: 1358 - DNA, 16 bp, Artificial sequence
  Synthetic oligonucleotide
ctatcttctatacttc

SEQ ID NO: 1359 - DNA, 16 bp, Artificial sequence
  Synthetic oligonucleotide
ttagtagctttttgat

SEQ ID NO: 1360 - DNA, 16 bp, Artificial sequence
  Synthetic oligonucleotide
ttacttccgttacgaa

SEQ ID NO: 1361 - DNA, 16 bp, Artificial sequence
  Synthetic oligonucleotide
aatgctagtcctcagg

SEQ ID NO: 1362 - DNA, 16 bp, Artificial sequence
  Synthetic oligonucleotide
gtcctagcttcatcaa

SEQ ID NO: 1363 - DNA, 16 bp, Artificial sequence
  Synthetic oligonucleotide
cctagcttccttcacc

SEQ ID NO: 1364 - DNA, 16 bp, Artificial sequence
  Synthetic oligonucleotide
ctccgtgtggttgcca

SEQ ID NO: 1365 - DNA, 16 bp, Artificial sequence
  Synthetic oligonucleotide
tttaccaaccactcgc

SEQ ID NO: 1366 - DNA, 16 bp, Artificial sequence
  Synthetic oligonucleotide
cccccattatattaga

SEQ ID NO: 1367 - DNA, 16 bp, Artificial sequence
  Synthetic oligonucleotide
aacacccggaaatcgg

SEQ ID NO: 1368 - DNA, 16 bp, Artificial sequence
  Synthetic oligonucleotide
aaacttgccatctact

SEQ ID NO: 1369 - DNA, 16 bp, Artificial sequence
  Synthetic oligonucleotide
aacaggtcatctattc

SEQ ID NO: 1370 - DNA, 16 bp, Artificial sequence
  Synthetic oligonucleotide
acatattttgccccca

SEQ ID NO: 1371 - DNA, 16 bp, Artificial sequence
  Synthetic oligonucleotide
gtctgattatcctgat

SEQ ID NO: 1372 - DNA, 16 bp, Artificial sequence
  Synthetic oligonucleotide
gcacttttaaagtctg

SEQ ID NO: 1373 - DNA, 16 bp, Artificial sequence
  Synthetic oligonucleotide
tacactccttctctaa

SEQ ID NO: 1374 - DNA, 16 bp, Artificial sequence
  Synthetic oligonucleotide
accaaagctgcactgt

SEQ ID NO: 1375 - DNA, 16 bp, Artificial sequence
  Synthetic oligonucleotide
ccgtaacaggccactg

SEQ ID NO: 1376 - DNA, 16 bp, Artificial sequence
  Synthetic oligonucleotide
gccaacttggaagttg

SEQ ID NO: 1377 - DNA, 16 bp, Artificial sequence
  Synthetic oligonucleotide
cactggtacacccagt

SEQ ID NO: 1378 - DNA, 16 bp, Artificial sequence
  Synthetic oligonucleotide
cagtaggccagaccaa

SEQ ID NO: 1379 - DNA, 16 bp, Artificial sequence
  Synthetic oligonucleotide
gatcattaagccactt

SEQ ID NO: 1380 - DNA, 16 bp, Artificial sequence
  Synthetic oligonucleotide
atttttgaagcatacc

SEQ ID NO: 1381 - DNA, 16 bp, Artificial sequence
  Synthetic oligonucleotide
ggctggttatgactca

SEQ ID NO: 1382 - DNA, 16 bp, Artificial sequence
  Synthetic oligonucleotide
ccccaatggaggtatg

SEQ ID NO: 1383 - DNA, 16 bp, Artificial sequence
  Synthetic oligonucleotide
attggtagctttcatt

SEQ ID NO: 1384 - DNA, 16 bp, Artificial sequence
  Synthetic oligonucleotide
gcctcttcattgtatt

SEQ ID NO: 1385 - DNA, 16 bp, Artificial sequence
  Synthetic oligonucleotide
cttgatcccaactcat

SEQ ID NO: 1386 - DNA, 16 bp, Artificial sequence
  Synthetic oligonucleotide
ataacgaagagatacc

SEQ ID NO: 1387 - DNA, 16 bp, Artificial sequence
  Synthetic oligonucleotide
taacatgcaatactgc

SEQ ID NO: 1388 - DNA, 16 bp, Artificial sequence
  Synthetic oligonucleotide
atcctgaaatccccta

SEQ ID NO: 1389 - DNA, 16 bp, Artificial sequence
  Synthetic oligonucleotide
tgaagtgtactatccc

SEQ ID NO: 1390 - DNA, 16 bp, Artificial sequence
  Synthetic oligonucleotide
tattcctttcatagag

SEQ ID NO: 1391 - DNA, 16 bp, Artificial sequence
  Synthetic oligonucleotide
tcccccccaagattgc

SEQ ID NO: 1392 - DNA, 16 bp, Artificial sequence
  Synthetic oligonucleotide
ctcaaatcctgatctg

SEQ ID NO: 1393 - DNA, 16 bp, Artificial sequence
  Synthetic oligonucleotide
tcccacctgtctaaga

SEQ ID NO: 1394 - DNA, 16 bp, Artificial sequence
  Synthetic oligonucleotide
ttactctaatcactgt

SEQ ID NO: 1395 - DNA, 16 bp, Artificial sequence
  Synthetic oligonucleotide
tataaggtcaatagtg

SEQ ID NO: 1396 - DNA, 16 bp, Artificial sequence
  Synthetic oligonucleotide
gcaaggtctcatacac

SEQ ID NO: 1397 - DNA, 16 bp, Artificial sequence
  Synthetic oligonucleotide
tacttgccaacagaac

SEQ ID NO: 1398 - DNA, 16 bp, Artificial sequence
  Synthetic oligonucleotide
cttttaatcatactcc

SEQ ID NO: 1399 - DNA, 16 bp, Artificial sequence
  Synthetic oligonucleotide
aatcacaaatacgact

SEQ ID NO: 1400 - DNA, 16 bp, Artificial sequence
  Synthetic oligonucleotide
atgcactaaagatcac

SEQ ID NO: 1401 - DNA, 16 bp, Artificial sequence
  Synthetic oligonucleotide
tccttctatagtctga

SEQ ID NO: 1402 - DNA, 16 bp, Artificial sequence
  Synthetic oligonucleotide
tcaatactattgtccc

SEQ ID NO: 1403 - DNA, 16 bp, Artificial sequence
  Synthetic oligonucleotide
ctttaagccttcggtg

SEQ ID NO: 1404 - DNA, 16 bp, Artificial sequence
  Synthetic oligonucleotide
ttgaggcaagtcctca

SEQ ID NO: 1405 - DNA, 16 bp, Artificial sequence
  Synthetic oligonucleotide
cgcttgagatttgggc

SEQ ID NO: 1406 - DNA, 16 bp, Artificial sequence
  Synthetic oligonucleotide
gtggcagagaagttgc

SEQ ID NO: 1407 - DNA, 16 bp, Artificial sequence
  Synthetic oligonucleotide
gattatggatcatgcc

SEQ ID NO: 1408 - DNA, 16 bp, Artificial sequence
  Synthetic oligonucleotide
taacatagttcaaccc

SEQ ID NO: 1409 - DNA, 16 bp, Artificial sequence
  Synthetic oligonucleotide
agtattataatagagc

SEQ ID NO: 1410 - DNA, 16 bp, Artificial sequence
  Synthetic oligonucleotide
tctacaagttacatgt

SEQ ID NO: 1411 - DNA, 16 bp, Artificial sequence
  Synthetic oligonucleotide
gctaagatgctagctt

SEQ ID NO: 1412 - DNA, 16 bp, Artificial sequence
  Synthetic oligonucleotide
gaaaccaggagtgcca

SEQ ID NO: 1413 - DNA, 16 bp, Artificial sequence
  Synthetic oligonucleotide
tccaagaactagcacc

SEQ ID NO: 1414 - DNA, 16 bp, Artificial sequence
  Synthetic oligonucleotide
atcaagtcaagctcct

SEQ ID NO: 1415 - DNA, 16 bp, Artificial sequence
  Synthetic oligonucleotide
ccacaacaatttagag

SEQ ID NO: 1416 - DNA, 16 bp, Artificial sequence
  Synthetic oligonucleotide
caaacttgccatctac

SEQ ID NO: 1417 - DNA, 16 bp, Artificial sequence
  Synthetic oligonucleotide
ggttaagcacttttaa

SEQ ID NO: 1418 - DNA, 16 bp, Artificial sequence
  Synthetic oligonucleotide
ggagaggccagttgcg

SEQ ID NO: 1419 - DNA, 16 bp, Artificial sequence
  Synthetic oligonucleotide
cctataaggacagcta

SEQ ID NO: 1420 - DNA, 16 bp, Artificial sequence
  Synthetic oligonucleotide
ttctgaaccggagcag

SEQ ID NO: 1421 - DNA, 16 bp, Artificial sequence
  Synthetic oligonucleotide
accttgggcagccagt

SEQ ID NO: 1422 - DNA, 16 bp, Artificial sequence
  Synthetic oligonucleotide
aagcgagttcaagtgg

SEQ ID NO: 1423 - DNA, 16 bp, Artificial sequence
  Synthetic oligonucleotide
ggaaatttttctaccg

SEQ ID NO: 1424 - DNA, 16 bp, Artificial sequence
  Synthetic oligonucleotide
gccagtggcccactct

SEQ ID NO: 1425 - DNA, 16 bp, Artificial sequence
  Synthetic oligonucleotide
gttcgagaaatcggag

SEQ ID NO: 1426 - DNA, 16 bp, Artificial sequence
  Synthetic oligonucleotide
gtggcaaaatggcgga

SEQ ID NO: 1427 - DNA, 16 bp, Artificial sequence
  Synthetic oligonucleotide
agtgtgatagttcagg

SEQ ID NO: 1428 - DNA, 16 bp, Artificial sequence
  Synthetic oligonucleotide
cccggaacttttaaaa

SEQ ID NO: 1429 - DNA, 16 bp, Artificial sequence
  Synthetic oligonucleotide
gaaagatttgagctgc

SEQ ID NO: 1430 - DNA, 16 bp, Artificial sequence
  Synthetic oligonucleotide
ggaggcaaaaagtagt

SEQ ID NO: 1431 - DNA, 16 bp, Artificial sequence
  Synthetic oligonucleotide
ggagaacaactcgcat

SEQ ID NO: 1432 - DNA, 16 bp, Artificial sequence
  Synthetic oligonucleotide
tcctcaagctccgcct

SEQ ID NO: 1433 - DNA, 16 bp, Artificial sequence
  Synthetic oligonucleotide
gcaatatcttagtaac

SEQ ID NO: 1434 - DNA, 16 bp, Artificial sequence
  Synthetic oligonucleotide
ttgcccttctattggt

SEQ ID NO: 1435 - DNA, 16 bp, Artificial sequence
  Synthetic oligonucleotide
ttaatcaccttcggtt

SEQ ID NO: 1436 - DNA, 16 bp, Artificial sequence
  Synthetic oligonucleotide
attgtttcatcctacc

SEQ ID NO: 1437 - DNA, 16 bp, Artificial sequence
  Synthetic oligonucleotide
cagtgctattttatcc

SEQ ID NO: 1438 - DNA, 16 bp, Artificial sequence
  Synthetic oligonucleotide
gtccttttagtagctt

SEQ ID NO: 1439 - DNA, 16 bp, Artificial sequence
  Synthetic oligonucleotide
attacttccgttacga

SEQ ID NO: 1440 - DNA, 16 bp, Artificial sequence
  Synthetic oligonucleotide
taatgctagtcctcag

SEQ ID NO: 1441 - DNA, 16 bp, Artificial sequence
  Synthetic oligonucleotide
agtcctagcttcatca

SEQ ID NO: 1442 - DNA, 16 bp, Artificial sequence
  Synthetic oligonucleotide
cctagcttcaccacca

SEQ ID NO: 1443 - DNA, 16 bp, Artificial sequence
  Synthetic oligonucleotide
tcctccgtgtggttgc

SEQ ID NO: 1444 - DNA, 16 bp, Artificial sequence
  Synthetic oligonucleotide
ttttaccaaccactcg

SEQ ID NO: 1445 - DNA, 16 bp, Artificial sequence
  Synthetic oligonucleotide
tcccccattatattag

SEQ ID NO: 1446 - DNA, 16 bp, Artificial sequence
  Synthetic oligonucleotide
caacacccggaaatcg

SEQ ID NO: 1447 - DNA, 16 bp, Artificial sequence
  Synthetic oligonucleotide
gtaaaaacaggtcatc

SEQ ID NO: 1448 - DNA, 16 bp, Artificial sequence
  Synthetic oligonucleotide
aacatattttgccccc

SEQ ID NO: 1449 - DNA, 16 bp, Artificial sequence
  Synthetic oligonucleotide
ctgtggtggtctgatt

SEQ ID NO: 1450 - DNA, 16 bp, Artificial sequence
  Synthetic oligonucleotide
gtacactccttctcta

SEQ ID NO: 1451 - DNA, 16 bp, Artificial sequence
  Synthetic oligonucleotide
tgaaccaaagctgcac

SEQ ID NO: 1452 - DNA, 16 bp, Artificial sequence
  Synthetic oligonucleotide
accgtaacaggccact

SEQ ID NO: 1453 - DNA, 16 bp, Artificial sequence
  Synthetic oligonucleotide
tgccaacttggaagtt

SEQ ID NO: 1454 - DNA, 16 bp, Artificial sequence
  Synthetic oligonucleotide
gcactggtacacccag

SEQ ID NO: 1455 - DNA, 16 bp, Artificial sequence
  Synthetic oligonucleotide
ccagtaggccagacca

SEQ ID NO: 1456 - DNA, 16 bp, Artificial sequence
  Synthetic oligonucleotide
ggatcattaagccact

SEQ ID NO: 1457 - DNA, 16 bp, Artificial sequence
  Synthetic oligonucleotide
tcttaatcagttacaa

SEQ ID NO: 1458 - DNA, 16 bp, Artificial sequence
  Synthetic oligonucleotide
caggctggttatgact

SEQ ID NO: 1459 - DNA, 16 bp, Artificial sequence
  Synthetic oligonucleotide
tccccaatggaggtat

SEQ ID NO: 1460 - DNA, 16 bp, Artificial sequence
  Synthetic oligonucleotide
aattggtagctttcat

SEQ ID NO: 1461 - DNA, 16 bp, Artificial sequence
  Synthetic oligonucleotide
cattgcctcttcattg

SEQ ID NO: 1462 - DNA, 16 bp, Artificial sequence
  Synthetic oligonucleotide
cacttgatcccaactc

SEQ ID NO: 1463 - DNA, 16 bp, Artificial sequence
  Synthetic oligonucleotide
gataacgaagagatac

SEQ ID NO: 1464 - DNA, 16 bp, Artificial sequence
  Synthetic oligonucleotide
ctaacatgcaatactg

SEQ ID NO: 1465 - DNA, 16 bp, Artificial sequence
  Synthetic oligonucleotide
caatcctgaaatcccc

SEQ ID NO: 1466 - DNA, 16 bp, Artificial sequence
  Synthetic oligonucleotide
agtgaagtgtactatc

SEQ ID NO: 1467 - DNA, 16 bp, Artificial sequence
  Synthetic oligonucleotide
ctattcctttcataga

SEQ ID NO: 1468 - DNA, 16 bp, Artificial sequence
  Synthetic oligonucleotide
atcccccccaagattg

SEQ ID NO: 1469 - DNA, 16 bp, Artificial sequence
  Synthetic oligonucleotide
cgctcaaatcctgatc

SEQ ID NO: 1470 - DNA, 16 bp, Artificial sequence
  Synthetic oligonucleotide
tctcccacctgtctaa

SEQ ID NO: 1471 - DNA, 16 bp, Artificial sequence
  Synthetic oligonucleotide
attactctaatcactg

SEQ ID NO: 1472 - DNA, 16 bp, Artificial sequence
  Synthetic oligonucleotide
atataaggtcaatagt

SEQ ID NO: 1473 - DNA, 16 bp, Artificial sequence
  Synthetic oligonucleotide
tgcaaggtctcataca

SEQ ID NO: 1474 - DNA, 16 bp, Artificial sequence
  Synthetic oligonucleotide
tttacttgccaacaga

SEQ ID NO: 1475 - DNA, 16 bp, Artificial sequence
  Synthetic oligonucleotide
acttttaatcatactc

SEQ ID NO: 1476 - DNA, 16 bp, Artificial sequence
  Synthetic oligonucleotide
caatcacaaatacgac

SEQ ID NO: 1477 - DNA, 16 bp, Artificial sequence
  Synthetic oligonucleotide
caatgcactaaagatc

SEQ ID NO: 1478 - DNA, 16 bp, Artificial sequence
  Synthetic oligonucleotide
tggaagctccttctat

SEQ ID NO: 1479 - DNA, 16 bp, Artificial sequence
  Synthetic oligonucleotide
ttcaatactattgtcc

SEQ ID NO: 1480 - DNA, 16 bp, Artificial sequence
  Synthetic oligonucleotide
actttaagccttcggt

SEQ ID NO: 1481 - DNA, 16 bp, Artificial sequence
  Synthetic oligonucleotide
gttgaggcaagtcctc

SEQ ID NO: 1482 - DNA, 16 bp, Artificial sequence
  Synthetic oligonucleotide
ccgcttgagatttggg

SEQ ID NO: 1483 - DNA, 16 bp, Artificial sequence
  Synthetic oligonucleotide
tggcgatgtggcagag

SEQ ID NO: 1484 - DNA, 16 bp, Artificial sequence
  Synthetic oligonucleotide
cgattatggatcatgc

SEQ ID NO: 1485 - DNA, 16 bp, Artificial sequence
  Synthetic oligonucleotide
ctaacatagttcaacc

SEQ ID NO: 1486 - DNA, 16 bp, Artificial sequence
  Synthetic oligonucleotide
ctggataagtattata

SEQ ID NO: 1487 - DNA, 16 bp, Artificial sequence
  Synthetic oligonucleotide
gtctacaagttacatg

SEQ ID NO: 1488 - DNA, 16 bp, Artificial sequence
  Synthetic oligonucleotide
cgctaagatgctagct

SEQ ID NO: 1489 - DNA, 16 bp, Artificial sequence
  Synthetic oligonucleotide
tggaaaccaggagtgc

SEQ ID NO: 1490 - DNA, 16 bp, Artificial sequence
  Synthetic oligonucleotide
actccaagaactagca

SEQ ID NO: 1491 - DNA, 16 bp, Artificial sequence
  Synthetic oligonucleotide
aatcaagtcaagctcc

SEQ ID NO: 1492 - DNA, 16 bp, Artificial sequence
  Synthetic oligonucleotide
accacaacaatttaga

SEQ ID NO: 1493 - DNA, 16 bp, Artificial sequence
  Synthetic oligonucleotide
cttaagagggcaggag

SEQ ID NO: 1494 - DNA, 16 bp, Artificial sequence
  Synthetic oligonucleotide
gcctataaggacagct

SEQ ID NO: 1495 - DNA, 16 bp, Artificial sequence
  Synthetic oligonucleotide
cttctgaaccggagca

SEQ ID NO: 1496 - DNA, 16 bp, Artificial sequence
  Synthetic oligonucleotide
cgaagacacagagacc

SEQ ID NO: 1497 - DNA, 16 bp, Artificial sequence
  Synthetic oligonucleotide
aaagcgagttcaagtg

SEQ ID NO: 1498 - DNA, 16 bp, Artificial sequence
  Synthetic oligonucleotide
cggaaatttttctacc

SEQ ID NO: 1499 - DNA, 16 bp, Artificial sequence
  Synthetic oligonucleotide
ccgttggctgccagtg

SEQ ID NO: 1500 - DNA, 16 bp, Artificial sequence
  Synthetic oligonucleotide
tgttcgagaaatcgga

SEQ ID NO: 1501 - DNA, 16 bp, Artificial sequence
  Synthetic oligonucleotide
gttgagaagtggcaaa

SEQ ID NO: 1502 - DNA, 16 bp, Artificial sequence
  Synthetic oligonucleotide
taaagtgtgatagttc

SEQ ID NO: 1503 - DNA, 16 bp, Artificial sequence
  Synthetic oligonucleotide
ccccggaacttttaaa

SEQ ID NO: 1504 - DNA, 16 bp, Artificial sequence
  Synthetic oligonucleotide
gtggaaagatttgagc

SEQ ID NO: 1505 - DNA, 16 bp, Artificial sequence
  Synthetic oligonucleotide
ttgtgagggaggcaaa

SEQ ID NO: 1506 - DNA, 16 bp, Artificial sequence
  Synthetic oligonucleotide
cggagaacaactcgca

SEQ ID NO: 1507 - DNA, 16 bp, Artificial sequence
  Synthetic oligonucleotide
tttcctcaagctccgc

SEQ ID NO: 1508 - DNA, 16 bp, Artificial sequence
  Synthetic oligonucleotide
taagcaatatcttagt

SEQ ID NO: 1509 - DNA, 16 bp, Artificial sequence
  Synthetic oligonucleotide
gcattgcccttctatt

SEQ ID NO: 1510 - DNA, 16 bp, Artificial sequence
  Synthetic oligonucleotide
tttaatcaccttcggt

SEQ ID NO: 1511 - DNA, 16 bp, Artificial sequence
  Synthetic oligonucleotide
ccaaattgtttcatcc

SEQ ID NO: 1512 - DNA, 16 bp, Artificial sequence
  Synthetic oligonucleotide
tcagtgctattttatc

SEQ ID NO: 1513 - DNA, 16 bp, Artificial sequence
  Synthetic oligonucleotide
cagtccttttagtagc

SEQ ID NO: 1514 - DNA, 16 bp, Artificial sequence
  Synthetic oligonucleotide
aattacttccgttacg

SEQ ID NO: 1515 - DNA, 16 bp, Artificial sequence
  Synthetic oligonucleotide
ttaatgctagtcctca

SEQ ID NO: 1516 - DNA, 16 bp, Artificial sequence
  Synthetic oligonucleotide
cagtcctagcttcatc

SEQ ID NO: 1517 - DNA, 16 bp, Artificial sequence
  Synthetic oligonucleotide
tcctagcttcaccacc

SEQ ID NO: 1518 - DNA, 16 bp, Artificial sequence
  Synthetic oligonucleotide
cctcctccgtgtggtt

SEQ ID NO: 1519 - DNA, 16 bp, Artificial sequence
  Synthetic oligonucleotide
tttttaccaaccactc

SEQ ID NO: 1520 - DNA, 16 bp, Artificial sequence
  Synthetic oligonucleotide
ctcccccattatatta

SEQ ID NO: 1521 - DNA, 16 bp, Artificial sequence
  Synthetic oligonucleotide
tacaacacccggaaat

SEQ ID NO: 1522 - DNA, 16 bp, Artificial sequence
  Synthetic oligonucleotide
acaaacttgccatcta

SEQ ID NO: 1523 - DNA, 16 bp, Artificial sequence
  Synthetic oligonucleotide
tcagggtgaggaagta

SEQ ID NO: 1524 - DNA, 16 bp, Artificial sequence
  Synthetic oligonucleotide
gacagacctaagggaa

SEQ ID NO: 1525 - DNA, 16 bp, Artificial sequence
  Synthetic oligonucleotide
cctgtggtggtctgat

SEQ ID NO: 1526 - DNA, 16 bp, Artificial sequence
  Synthetic oligonucleotide
gggttaagcactttta

SEQ ID NO: 1527 - DNA, 16 bp, Artificial sequence
  Synthetic oligonucleotide
cggtacactccttctc

SEQ ID NO: 1528 - DNA, 16 bp, Artificial sequence
  Synthetic oligonucleotide
tatgaaccaaagctgc

SEQ ID NO: 1529 - DNA, 16 bp, Artificial sequence
  Synthetic oligonucleotide
aaccgtaacaggccac

SEQ ID NO: 1530 - DNA, 16 bp, Artificial sequence
  Synthetic oligonucleotide
tacttgccaacttgga

SEQ ID NO: 1531 - DNA, 16 bp, Artificial sequence
  Synthetic oligonucleotide
atgcactggtacaccc

SEQ ID NO: 1532 - DNA, 16 bp, Artificial sequence
  Synthetic oligonucleotide
gcccagtaggccagac

SEQ ID NO: 1533 - DNA, 16 bp, Artificial sequence
  Synthetic oligonucleotide
caggatcattaagcca

SEQ ID NO: 1534 - DNA, 16 bp, Artificial sequence
  Synthetic oligonucleotide
cacaattcttaatcag

SEQ ID NO: 1535 - DNA, 16 bp, Artificial sequence
  Synthetic oligonucleotide
ccaggctggttatgac

SEQ ID NO: 1536 - DNA, 16 bp, Artificial sequence
  Synthetic oligonucleotide
attccccaatggaggt

SEQ ID NO: 1537 - DNA, 16 bp, Artificial sequence
  Synthetic oligonucleotide
taaattggtagctttc

SEQ ID NO: 1538 - DNA, 16 bp, Artificial sequence
  Synthetic oligonucleotide
ggacattgcctcttca

SEQ ID NO: 1539 - DNA, 16 bp, Artificial sequence
  Synthetic oligonucleotide
ccacttgatcccaact

SEQ ID NO: 1540 - DNA, 16 bp, Artificial sequence
  Synthetic oligonucleotide
tgataacgaagagata

SEQ ID NO: 1541 - DNA, 16 bp, Artificial sequence
  Synthetic oligonucleotide
cctaacatgcaatact

SEQ ID NO: 1542 - DNA, 16 bp, Artificial sequence
  Synthetic oligonucleotide
tcgatggaaaaatttc

SEQ ID NO: 1543 - DNA, 16 bp, Artificial sequence
  Synthetic oligonucleotide
gagtgaagtgtactat

SEQ ID NO: 1544 - DNA, 16 bp, Artificial sequence
  Synthetic oligonucleotide
gctattcctttcatag

SEQ ID NO: 1545 - DNA, 16 bp, Artificial sequence
  Synthetic oligonucleotide
aatcccccccaagatt

SEQ ID NO: 1546 - DNA, 16 bp, Artificial sequence
  Synthetic oligonucleotide
tccgctcaaatcctga

SEQ ID NO: 1547 - DNA, 16 bp, Artificial sequence
  Synthetic oligonucleotide
atctcccacctgtcta

SEQ ID NO: 1548 - DNA, 16 bp, Artificial sequence
  Synthetic oligonucleotide
gtattactctaatcac

SEQ ID NO: 1549 - DNA, 16 bp, Artificial sequence
  Synthetic oligonucleotide
tatataaggtcaatag

SEQ ID NO: 1550 - DNA, 16 bp, Artificial sequence
  Synthetic oligonucleotide
ctgcaaggtctcatac

SEQ ID NO: 1551 - DNA, 16 bp, Artificial sequence
  Synthetic oligonucleotide
atttacttgccaacag

SEQ ID NO: 1552 - DNA, 16 bp, Artificial sequence
  Synthetic oligonucleotide
gggaacacaactttta

SEQ ID NO: 1553 - DNA, 16 bp, Artificial sequence
  Synthetic oligonucleotide
tcaatcacaaatacga

SEQ ID NO: 1554 - DNA, 16 bp, Artificial sequence
  Synthetic oligonucleotide
cataaacaatgcacta

SEQ ID NO: 1555 - DNA, 16 bp, Artificial sequence
  Synthetic oligonucleotide
ctggaagctccttcta

SEQ ID NO: 1556 - DNA, 16 bp, Artificial sequence
  Synthetic oligonucleotide
attcaatactattgtc

SEQ ID NO: 1557 - DNA, 16 bp, Artificial sequence
  Synthetic oligonucleotide
tactttaagccttcgg

SEQ ID NO: 1558 - DNA, 16 bp, Artificial sequence
  Synthetic oligonucleotide
gagttgaggcaagtcc

SEQ ID NO: 1559 - DNA, 16 bp, Artificial sequence
  Synthetic oligonucleotide
accgcttgagatttgg

SEQ ID NO: 1560 - DNA, 16 bp, Artificial sequence
  Synthetic oligonucleotide
gtggcgatgtggcaga

SEQ ID NO: 1561 - DNA, 16 bp, Artificial sequence
  Synthetic oligonucleotide
ccgattatggatcatg

SEQ ID NO: 1562 - DNA, 16 bp, Artificial sequence
  Synthetic oligonucleotide
tctaacatagttcaac

SEQ ID NO: 1563 - DNA, 16 bp, Artificial sequence
  Synthetic oligonucleotide
actggataagtattat

SEQ ID NO: 1564 - DNA, 16 bp, Artificial sequence
  Synthetic oligonucleotide
agtctacaagttacat

SEQ ID NO: 1565 - DNA, 16 bp, Artificial sequence
  Synthetic oligonucleotide
ccgctaagatgctagc

SEQ ID NO: 1566 - DNA, 16 bp, Artificial sequence
  Synthetic oligonucleotide
cgtcctggaaaccagg

SEQ ID NO: 1567 - DNA, 16 bp, Artificial sequence
  Synthetic oligonucleotide
aactccaagaactagc

SEQ ID NO: 1568 - DNA, 16 bp, Artificial sequence
  Synthetic oligonucleotide
caatcaagtcaagctc

SEQ ID NO: 1569 - DNA, 16 bp, Artificial sequence
  Synthetic oligonucleotide
aaccacaacaatttag

SEQ ID NO: 1570 - DNA, 16 bp, Artificial sequence
  Synthetic oligonucleotide
ccgtcctggaaaccag

SEQ ID NO: 1571 - DNA, 16 bp, Artificial sequence
  Synthetic oligonucleotide
tgagtgaagtgtacta

SEQ ID NO: 1572 - DNA, 16 bp, Artificial sequence
  Synthetic oligonucleotide
ttaagaccaagggagg

SEQ ID NO: 1573 - DNA, 16 bp, Artificial sequence
  Synthetic oligonucleotide
gcttaagagggcagga

SEQ ID NO: 1574 - DNA, 16 bp, Artificial sequence
  Synthetic oligonucleotide
agcctataaggacagc

SEQ ID NO: 1575 - DNA, 16 bp, Artificial sequence
  Synthetic oligonucleotide
ccttctgaaccggagc

SEQ ID NO: 1576 - DNA, 16 bp, Artificial sequence
  Synthetic oligonucleotide
ccgaagacacagagac

SEQ ID NO: 1577 - DNA, 16 bp, Artificial sequence
  Synthetic oligonucleotide
gaaagcgagttcaagt

SEQ ID NO: 1578 - DNA, 16 bp, Artificial sequence
  Synthetic oligonucleotide
acggaaatttttctac

SEQ ID NO: 1579 - DNA, 16 bp, Artificial sequence
  Synthetic oligonucleotide
gccgttggctgccagt

SEQ ID NO: 1580 - DNA, 16 bp, Artificial sequence
  Synthetic oligonucleotide
ttgttcgagaaatcgg

SEQ ID NO: 1581 - DNA, 16 bp, Artificial sequence
  Synthetic oligonucleotide
cggttgagaagtggca

SEQ ID NO: 1582 - DNA, 16 bp, Artificial sequence
  Synthetic oligonucleotide
ttaaagtgtgatagtt

SEQ ID NO: 1583 - DNA, 16 bp, Artificial sequence
  Synthetic oligonucleotide
cccccggaacttttaa

SEQ ID NO: 1584 - DNA, 16 bp, Artificial sequence
  Synthetic oligonucleotide
cgtgtggaaagatttg

SEQ ID NO: 1585 - DNA, 16 bp, Artificial sequence
  Synthetic oligonucleotide
cctttgtgagggaggc

SEQ ID NO: 1586 - DNA, 16 bp, Artificial sequence
  Synthetic oligonucleotide
acggagaacaactcgc

SEQ ID NO: 1587 - DNA, 16 bp, Artificial sequence
  Synthetic oligonucleotide
gtttcctcaagctccg

SEQ ID NO: 1588 - DNA, 16 bp, Artificial sequence
  Synthetic oligonucleotide
ctaagcaatatcttag

SEQ ID NO: 1589 - DNA, 16 bp, Artificial sequence
  Synthetic oligonucleotide
aagcattgcccttcta

SEQ ID NO: 1590 - DNA, 16 bp, Artificial sequence
  Synthetic oligonucleotide
ttttaatcaccttcgg

SEQ ID NO: 1591 - DNA, 16 bp, Artificial sequence
  Synthetic oligonucleotide
cgtacttctgtcttcc

SEQ ID NO: 1592 - DNA, 16 bp, Artificial sequence
  Synthetic oligonucleotide
gttaccaataatttcc

SEQ ID NO: 1593 - DNA, 16 bp, Artificial sequence
  Synthetic oligonucleotide
accagtccttttagta

SEQ ID NO: 1594 - DNA, 16 bp, Artificial sequence
  Synthetic oligonucleotide
gaattacttccgttac

SEQ ID NO: 1595 - DNA, 16 bp, Artificial sequence
  Synthetic oligonucleotide
attaatgctagtcctc

SEQ ID NO: 1596 - DNA, 16 bp, Artificial sequence
  Synthetic oligonucleotide
ctcagtcctagcttca

SEQ ID NO: 1597 - DNA, 16 bp, Artificial sequence
  Synthetic oligonucleotide
ttcctagcttcaccac

SEQ ID NO: 1598 - DNA, 16 bp, Artificial sequence
  Synthetic oligonucleotide
gcctcctccgtgtggt

SEQ ID NO: 1599 - DNA, 16 bp, Artificial sequence
  Synthetic oligonucleotide
gatttttaccaaccac

SEQ ID NO: 1600 - DNA, 16 bp, Artificial sequence
  Synthetic oligonucleotide
actcccccattatatt

SEQ ID NO: 1601 - DNA, 16 bp, Artificial sequence
  Synthetic oligonucleotide
ctacaacacccggaaa

SEQ ID NO: 1602 - DNA, 16 bp, Artificial sequence
  Synthetic oligonucleotide
cccacaaacttgccat

SEQ ID NO: 1603 - DNA, 16 bp, Artificial sequence
  Synthetic oligonucleotide
cgaattcagggtgagg

SEQ ID NO: 1604 - DNA, 16 bp, Artificial sequence
  Synthetic oligonucleotide
agacagacctaaggga

SEQ ID NO: 1605 - DNA, 16 bp, Artificial sequence
  Synthetic oligonucleotide
taaacctgtggtggtc

SEQ ID NO: 1606 - DNA, 16 bp, Artificial sequence
  Synthetic oligonucleotide
ataacaagtttaaggg

SEQ ID NO: 1607 - DNA, 16 bp, Artificial sequence
  Synthetic oligonucleotide
gcggtacactccttct

SEQ ID NO: 1608 - DNA, 16 bp, Artificial sequence
  Synthetic oligonucleotide
gactgaatatgaacca

SEQ ID NO: 1609 - DNA, 16 bp, Artificial sequence
  Synthetic oligonucleotide
caaccgtaacaggcca

SEQ ID NO: 1610 - DNA, 16 bp, Artificial sequence
  Synthetic oligonucleotide
ttacttgccaacttgg

SEQ ID NO: 1611 - DNA, 16 bp, Artificial sequence
  Synthetic oligonucleotide
taatgcactggtacac

SEQ ID NO: 1612 - DNA, 16 bp, Artificial sequence
  Synthetic oligonucleotide
taatgtcagcccagta

SEQ ID NO: 1613 - DNA, 16 bp, Artificial sequence
  Synthetic oligonucleotide
tcaggatcattaagcc

SEQ ID NO: 1614 - DNA, 16 bp, Artificial sequence
  Synthetic oligonucleotide
actatcacaattctta

SEQ ID NO: 1615 - DNA, 16 bp, Artificial sequence
  Synthetic oligonucleotide
ctgccaggctggttat

SEQ ID NO: 1616 - DNA, 16 bp, Artificial sequence
  Synthetic oligonucleotide
tattccccaatggagg

SEQ ID NO: 1617 - DNA, 16 bp, Artificial sequence
  Synthetic oligonucleotide
ctttaaattggtagct

SEQ ID NO: 1618 - DNA, 16 bp, Artificial sequence
  Synthetic oligonucleotide
tggacattgcctcttc

SEQ ID NO: 1619 - DNA, 16 bp, Artificial sequence
  Synthetic oligonucleotide
tccacttgatcccaac

SEQ ID NO: 1620 - DNA, 16 bp, Artificial sequence
  Synthetic oligonucleotide
ctgataacgaagagat

SEQ ID NO: 1621 - DNA, 16 bp, Artificial sequence
  Synthetic oligonucleotide
ccctaacatgcaatac

SEQ ID NO: 1622 - DNA, 16 bp, Artificial sequence
  Synthetic oligonucleotide
ctcgatggaaaaattt

SEQ ID NO: 1623 - DNA, 16 bp, Artificial sequence
  Synthetic oligonucleotide
gcacatcatgctattc

SEQ ID NO: 1624 - DNA, 16 bp, Artificial sequence
  Synthetic oligonucleotide
gaatcccccccaagat

SEQ ID NO: 1625 - DNA, 16 bp, Artificial sequence
  Synthetic oligonucleotide
ttccgctcaaatcctg

SEQ ID NO: 1626 - DNA, 16 bp, Artificial sequence
  Synthetic oligonucleotide
taatctcccacctgtc

SEQ ID NO: 1627 - DNA, 16 bp, Artificial sequence
  Synthetic oligonucleotide
agtattactctaatca

SEQ ID NO: 1628 - DNA, 16 bp, Artificial sequence
  Synthetic oligonucleotide
ctatataaggtcaata

SEQ ID NO: 1629 - DNA, 16 bp, Artificial sequence
  Synthetic oligonucleotide
actgcaaggtctcata

SEQ ID NO: 1630 - DNA, 16 bp, Artificial sequence
  Synthetic oligonucleotide
gcatttacttgccaac

SEQ ID NO: 1631 - DNA, 16 bp, Artificial sequence
  Synthetic oligonucleotide
tactccaagcattggg

SEQ ID NO: 1632 - DNA, 16 bp, Artificial sequence
  Synthetic oligonucleotide
ttcaatcacaaatacg

SEQ ID NO: 1633 - DNA, 16 bp, Artificial sequence
  Synthetic oligonucleotide
aactggaagctccttc

SEQ ID NO: 1634 - DNA, 16 bp, Artificial sequence
  Synthetic oligonucleotide
gaaatctattcaatac

SEQ ID NO: 1635 - DNA, 16 bp, Artificial sequence
  Synthetic oligonucleotide
ctactttaagccttcg

SEQ ID NO: 1636 - DNA, 16 bp, Artificial sequence
  Synthetic oligonucleotide
ggagttgaggcaagtc

SEQ ID NO: 1637 - DNA, 16 bp, Artificial sequence
  Synthetic oligonucleotide
caccgcttgagatttg

SEQ ID NO: 1638 - DNA, 16 bp, Artificial sequence
  Synthetic oligonucleotide
gatcaaaaggcacggg

SEQ ID NO: 1639 - DNA, 16 bp, Artificial sequence
  Synthetic oligonucleotide
accgattatggatcat

SEQ ID NO: 1640 - DNA, 16 bp, Artificial sequence
  Synthetic oligonucleotide
ccttttctaacatagt

SEQ ID NO: 1641 - DNA, 16 bp, Artificial sequence
  Synthetic oligonucleotide
cactggataagtatta

SEQ ID NO: 1642 - DNA, 16 bp, Artificial sequence
  Synthetic oligonucleotide
cagtctacaagttaca

SEQ ID NO: 1643 - DNA, 16 bp, Artificial sequence
  Synthetic oligonucleotide
tccgctaagatgctag

SEQ ID NO: 1644 - DNA, 16 bp, Artificial sequence
  Synthetic oligonucleotide
gctgttacctcccacc

SEQ ID NO: 1645 - DNA, 16 bp, Artificial sequence
  Synthetic oligonucleotide
acaatcaagtcaagct

SEQ ID NO: 1646 - DNA, 16 bp, Artificial sequence
  Synthetic oligonucleotide
gaaccacaacaattta

SEQ ID NO: 1647 - DNA, 16 bp, Artificial sequence
  Synthetic oligonucleotide
cgcttaagagggcagg

SEQ ID NO: 1648 - DNA, 16 bp, Artificial sequence
  Synthetic oligonucleotide
ctaaaagcattgccct

SEQ ID NO: 1649 - DNA, 16 bp, Artificial sequence
  Synthetic oligonucleotide
atccacttgatcccaa

SEQ ID NO: 1650 - DNA, 16 bp, Artificial sequence
  Synthetic oligonucleotide
cagcctataaggacag

SEQ ID NO: 1651 - DNA, 16 bp, Artificial sequence
  Synthetic oligonucleotide
accttctgaaccggag

SEQ ID NO: 1652 - DNA, 16 bp, Artificial sequence
  Synthetic oligonucleotide
ctccgaagacacagag

SEQ ID NO: 1653 - DNA, 16 bp, Artificial sequence
  Synthetic oligonucleotide
ggaaagcgagttcaag

SEQ ID NO: 1654 - DNA, 16 bp, Artificial sequence
  Synthetic oligonucleotide
cacggaaatttttcta

SEQ ID NO: 1655 - DNA, 16 bp, Artificial sequence
  Synthetic oligonucleotide
ggccgttggctgccag

SEQ ID NO: 1656 - DNA, 16 bp, Artificial sequence
  Synthetic oligonucleotide
tttttgttcgagaaat

SEQ ID NO: 1657 - DNA, 16 bp, Artificial sequence
  Synthetic oligonucleotide
acggttgagaagtggc

SEQ ID NO: 1658 - DNA, 16 bp, Artificial sequence
  Synthetic oligonucleotide
attaaagtgtgatagt

SEQ ID NO: 1659 - DNA, 16 bp, Artificial sequence
  Synthetic oligonucleotide
acccccggaactttta

SEQ ID NO: 1660 - DNA, 16 bp, Artificial sequence
  Synthetic oligonucleotide
acttaaattactagcg

SEQ ID NO: 1661 - DNA, 16 bp, Artificial sequence
  Synthetic oligonucleotide
gcctttgtgagggagg

SEQ ID NO: 1662 - DNA, 16 bp, Artificial sequence
  Synthetic oligonucleotide
agacggagaacaactc

SEQ ID NO: 1663 - DNA, 16 bp, Artificial sequence
  Synthetic oligonucleotide
ggtttcctcaagctcc

SEQ ID NO: 1664 - DNA, 16 bp, Artificial sequence
  Synthetic oligonucleotide
gctaagcaatatctta

SEQ ID NO: 1665 - DNA, 16 bp, Artificial sequence
  Synthetic oligonucleotide
cttttaatcaccttcg

SEQ ID NO: 1666 - DNA, 16 bp, Artificial sequence
  Synthetic oligonucleotide
ccgtacttctgtcttc

SEQ ID NO: 1667 - DNA, 16 bp, Artificial sequence
  Synthetic oligonucleotide
ttacaccagtcctttt

SEQ ID NO: 1668 - DNA, 16 bp, Artificial sequence
  Synthetic oligonucleotide
tgaattacttccgtta

SEQ ID NO: 1669 - DNA, 16 bp, Artificial sequence
  Synthetic oligonucleotide
aattaatgctagtcct

SEQ ID NO: 1670 - DNA, 16 bp, Artificial sequence
  Synthetic oligonucleotide
tgctcctcagtcctag

SEQ ID NO: 1671 - DNA, 16 bp, Artificial sequence
  Synthetic oligonucleotide
ttttcctagcttcacc

SEQ ID NO: 1672 - DNA, 16 bp, Artificial sequence
  Synthetic oligonucleotide
tcgcctcctccgtgtg

SEQ ID NO: 1673 - DNA, 16 bp, Artificial sequence
  Synthetic oligonucleotide
ggatttttaccaacca

SEQ ID NO: 1674 - DNA, 16 bp, Artificial sequence
  Synthetic oligonucleotide
aactcccccattatat

SEQ ID NO: 1675 - DNA, 16 bp, Artificial sequence
  Synthetic oligonucleotide
cctacaacacccggaa

SEQ ID NO: 1676 - DNA, 16 bp, Artificial sequence
  Synthetic oligonucleotide
acccacaaacttgcca

SEQ ID NO: 1677 - DNA, 16 bp, Artificial sequence
  Synthetic oligonucleotide
aaacgaattcagggtg

SEQ ID NO: 1678 - DNA, 16 bp, Artificial sequence
  Synthetic oligonucleotide
ctagacagacctaagg

SEQ ID NO: 1679 - DNA, 16 bp, Artificial sequence
  Synthetic oligonucleotide
gtaaacctgtggtggt

SEQ ID NO: 1680 - DNA, 16 bp, Artificial sequence
  Synthetic oligonucleotide
gaccatcccaaaatgc

SEQ ID NO: 1681 - DNA, 16 bp, Artificial sequence
  Synthetic oligonucleotide
agcggtacactccttc

SEQ ID NO: 1682 - DNA, 16 bp, Artificial sequence
  Synthetic oligonucleotide
tgactgaatatgaacc

SEQ ID NO: 1683 - DNA, 16 bp, Artificial sequence
  Synthetic oligonucleotide
ccaaccgtaacaggcc

SEQ ID NO: 1684 - DNA, 16 bp, Artificial sequence
  Synthetic oligonucleotide
gttacttgccaacttg

SEQ ID NO: 1685 - DNA, 16 bp, Artificial sequence
  Synthetic oligonucleotide
ttaatgcactggtaca

SEQ ID NO: 1686 - DNA, 16 bp, Artificial sequence
  Synthetic oligonucleotide
ttaatgtcagcccagt

SEQ ID NO: 1687 - DNA, 16 bp, Artificial sequence
  Synthetic oligonucleotide
ttcaggatcattaagc

SEQ ID NO: 1688 - DNA, 16 bp, Artificial sequence
  Synthetic oligonucleotide
gaactatcacaattct

SEQ ID NO: 1689 - DNA, 16 bp, Artificial sequence
  Synthetic oligonucleotide
tcatactgccaggctg

SEQ ID NO: 1690 - DNA, 16 bp, Artificial sequence
  Synthetic oligonucleotide
ttattccccaatggag

SEQ ID NO: 1691 - DNA, 16 bp, Artificial sequence
  Synthetic oligonucleotide
actttaaattggtagc

SEQ ID NO: 1692 - DNA, 16 bp, Artificial sequence
  Synthetic oligonucleotide
atggacattgcctctt

SEQ ID NO: 1693 - DNA, 16 bp, Artificial sequence
  Synthetic oligonucleotide
tctgataacgaagaga

SEQ ID NO: 1694 - DNA, 16 bp, Artificial sequence
  Synthetic oligonucleotide
tccctaacatgcaata

SEQ ID NO: 1695 - DNA, 16 bp, Artificial sequence
  Synthetic oligonucleotide
gctcgatggaaaaatt

SEQ ID NO: 1696 - DNA, 16 bp, Artificial sequence
  Synthetic oligonucleotide
ctgagtgaagtgtact

SEQ ID NO: 1697 - DNA, 16 bp, Artificial sequence
  Synthetic oligonucleotide
agcacatcatgctatt

SEQ ID NO: 1698 - DNA, 16 bp, Artificial sequence
  Synthetic oligonucleotide
aagaatcccccccaag

SEQ ID NO: 1699 - DNA, 16 bp, Artificial sequence
  Synthetic oligonucleotide
tcttccgctcaaatcc

SEQ ID NO: 1700 - DNA, 16 bp, Artificial sequence
  Synthetic oligonucleotide
ataatctcccacctgt

SEQ ID NO: 1701 - DNA, 16 bp, Artificial sequence
  Synthetic oligonucleotide
aagtattactctaatc

SEQ ID NO: 1702 - DNA, 16 bp, Artificial sequence
  Synthetic oligonucleotide
ccctatataaggtcaa

SEQ ID NO: 1703 - DNA, 16 bp, Artificial sequence
  Synthetic oligonucleotide
cactgcaaggtctcat

SEQ ID NO: 1704 - DNA, 16 bp, Artificial sequence
  Synthetic oligonucleotide
ctgcatttacttgcca

SEQ ID NO: 1705 - DNA, 16 bp, Artificial sequence
  Synthetic oligonucleotide
ctactccaagcattgg

SEQ ID NO: 1706 - DNA, 16 bp, Artificial sequence
  Synthetic oligonucleotide
agcttcaatcacaaat

SEQ ID NO: 1707 - DNA, 16 bp, Artificial sequence
  Synthetic oligonucleotide
gaattaagaccaaggg

SEQ ID NO: 1708 - DNA, 16 bp, Artificial sequence
  Synthetic oligonucleotide
caactggaagctcctt

SEQ ID NO: 1709 - DNA, 16 bp, Artificial sequence
  Synthetic oligonucleotide
gctgaaatctattcaa

SEQ ID NO: 1710 - DNA, 16 bp, Artificial sequence
  Synthetic oligonucleotide
cctactttaagccttc

SEQ ID NO: 1711 - DNA, 16 bp, Artificial sequence
  Synthetic oligonucleotide
gggagttgaggcaagt

SEQ ID NO: 1712 - DNA, 16 bp, Artificial sequence
  Synthetic oligonucleotide
agcaccgcttgagatt

SEQ ID NO: 1713 - DNA, 16 bp, Artificial sequence
  Synthetic oligonucleotide
agatcaaaaggcacgg

SEQ ID NO: 1714 - DNA, 16 bp, Artificial sequence
  Synthetic oligonucleotide
aaccgattatggatca

SEQ ID NO: 1715 - DNA, 16 bp, Artificial sequence
  Synthetic oligonucleotide
gccttttctaacatag

SEQ ID NO: 1716 - DNA, 16 bp, Artificial sequence
  Synthetic oligonucleotide
gtcactggataagtat

SEQ ID NO: 1717 - DNA, 16 bp, Artificial sequence
  Synthetic oligonucleotide
ccagtctacaagttac

SEQ ID NO: 1718 - DNA, 16 bp, Artificial sequence
  Synthetic oligonucleotide
ttccgctaagatgcta

SEQ ID NO: 1719 - DNA, 16 bp, Artificial sequence
  Synthetic oligonucleotide
ccccgtcctggaaacc

SEQ ID NO: 1720 - DNA, 16 bp, Artificial sequence
  Synthetic oligonucleotide
tgctgttacctcccac

SEQ ID NO: 1721 - DNA, 16 bp, Artificial sequence
  Synthetic oligonucleotide
tacaatcaagtcaagc

SEQ ID NO: 1722 - DNA, 16 bp, Artificial sequence
  Synthetic oligonucleotide
ccccaatcaagatttt

SEQ ID NO: 1723 - DNA, 16 bp, Artificial sequence
  Synthetic oligonucleotide
acctacaacacccgga

SEQ ID NO: 1724 - DNA, 16 bp, Artificial sequence
  Synthetic oligonucleotide
gcgcttaagagggcag

SEQ ID NO: 1725 - DNA, 16 bp, Artificial sequence
  Synthetic oligonucleotide
ccagcctataaggaca

SEQ ID NO: 1726 - DNA, 16 bp, Artificial sequence
  Synthetic oligonucleotide
cagaccttctgaaccg

SEQ ID NO: 1727 - DNA, 16 bp, Artificial sequence
  Synthetic oligonucleotide
tctccgaagacacaga

SEQ ID NO: 1728 - DNA, 16 bp, Artificial sequence
  Synthetic oligonucleotide
tggaaagcgagttcaa

SEQ ID NO: 1729 - DNA, 16 bp, Artificial sequence
  Synthetic oligonucleotide
gcacggaaatttttct

SEQ ID NO: 1730 - DNA, 16 bp, Artificial sequence
  Synthetic oligonucleotide
ccgcctgagccccggg

SEQ ID NO: 1731 - DNA, 16 bp, Artificial sequence
  Synthetic oligonucleotide
ccaagacagccacacg

SEQ ID NO: 1732 - DNA, 16 bp, Artificial sequence
  Synthetic oligonucleotide
gacggttgagaagtgg

SEQ ID NO: 1733 - DNA, 16 bp, Artificial sequence
  Synthetic oligonucleotide
gattaaagtgtgatag

SEQ ID NO: 1734 - DNA, 16 bp, Artificial sequence
  Synthetic oligonucleotide
aacccccggaactttt

SEQ ID NO: 1735 - DNA, 16 bp, Artificial sequence
  Synthetic oligonucleotide
tacttaaattactagc

SEQ ID NO: 1736 - DNA, 16 bp, Artificial sequence
  Synthetic oligonucleotide
cgcctttgtgagggag

SEQ ID NO: 1737 - DNA, 16 bp, Artificial sequence
  Synthetic oligonucleotide
tagacggagaacaact

SEQ ID NO: 1738 - DNA, 16 bp, Artificial sequence
  Synthetic oligonucleotide
gcggtttcctcaagct

SEQ ID NO: 1739 - DNA, 16 bp, Artificial sequence
  Synthetic oligonucleotide
cgctaagcaatatctt

SEQ ID NO: 1740 - DNA, 16 bp, Artificial sequence
  Synthetic oligonucleotide
tctaaaagcattgccc

SEQ ID NO: 1741 - DNA, 16 bp, Artificial sequence
  Synthetic oligonucleotide
tcaaggtcttttaatc

SEQ ID NO: 1742 - DNA, 16 bp, Artificial sequence
  Synthetic oligonucleotide
tcccgtacttctgtct

SEQ ID NO: 1743 - DNA, 16 bp, Artificial sequence
  Synthetic oligonucleotide
ttggttaccaataatt

SEQ ID NO: 1744 - DNA, 16 bp, Artificial sequence
  Synthetic oligonucleotide
attacaccagtccttt

SEQ ID NO: 1745 - DNA, 16 bp, Artificial sequence
  Synthetic oligonucleotide
ttgaattacttccgtt

SEQ ID NO: 1746 - DNA, 16 bp, Artificial sequence
  Synthetic oligonucleotide
caattaatgctagtcc

SEQ ID NO: 1747 - DNA, 16 bp, Artificial sequence
  Synthetic oligonucleotide
cgcttgctcctcagtc

SEQ ID NO: 1748 - DNA, 16 bp, Artificial sequence
  Synthetic oligonucleotide
cgctccttcctggaat

SEQ ID NO: 1749 - DNA, 16 bp, Artificial sequence
  Synthetic oligonucleotide
ctcgcctcctccgtgt

SEQ ID NO: 1750 - DNA, 16 bp, Artificial sequence
  Synthetic oligonucleotide
cggatttttaccaacc

SEQ ID NO: 1751 - DNA, 16 bp, Artificial sequence
  Synthetic oligonucleotide
gaaactcccccattat

SEQ ID NO: 1752 - DNA, 16 bp, Artificial sequence
  Synthetic oligonucleotide
ggctatcaaattcatt

SEQ ID NO: 1753 - DNA, 16 bp, Artificial sequence
  Synthetic oligonucleotide
aaaacgaattcagggt

SEQ ID NO: 1754 - DNA, 16 bp, Artificial sequence
  Synthetic oligonucleotide
tctagacagacctaag

SEQ ID NO: 1755 - DNA, 16 bp, Artificial sequence
  Synthetic oligonucleotide
tgtaaacctgtggtgg

SEQ ID NO: 1756 - DNA, 16 bp, Artificial sequence
  Synthetic oligonucleotide
taagaccatcccaaaa

SEQ ID NO: 1757 - DNA, 16 bp, Artificial sequence
  Synthetic oligonucleotide
cagcggtacactcctt

SEQ ID NO: 1758 - DNA, 16 bp, Artificial sequence
  Synthetic oligonucleotide
ctcctgagatgactga

SEQ ID NO: 1759 - DNA, 16 bp, Artificial sequence
  Synthetic oligonucleotide
cccaaccgtaacaggc

SEQ ID NO: 1760 - DNA, 16 bp, Artificial sequence
  Synthetic oligonucleotide
agttacttgccaactt

SEQ ID NO: 1761 - DNA, 16 bp, Artificial sequence
  Synthetic oligonucleotide
attaatgcactggtac

SEQ ID NO: 1762 - DNA, 16 bp, Artificial sequence
  Synthetic oligonucleotide
gttaatgtcagcccag

SEQ ID NO: 1763 - DNA, 16 bp, Artificial sequence
  Synthetic oligonucleotide
cttcaggatcattaag

SEQ ID NO: 1764 - DNA, 16 bp, Artificial sequence
  Synthetic oligonucleotide
tgaactatcacaattc

SEQ ID NO: 1765 - DNA, 16 bp, Artificial sequence
  Synthetic oligonucleotide
catcatactgccaggc

SEQ ID NO: 1766 - DNA, 16 bp, Artificial sequence
  Synthetic oligonucleotide
gcttattccccaatgg

SEQ ID NO: 1767 - DNA, 16 bp, Artificial sequence
  Synthetic oligonucleotide
gtaactttaaattggt

SEQ ID NO: 1768 - DNA, 16 bp, Artificial sequence
  Synthetic oligonucleotide
gatggacattgcctct

SEQ ID NO: 1769 - DNA, 16 bp, Artificial sequence
  Synthetic oligonucleotide
caatccacttgatccc

SEQ ID NO: 1770 - DNA, 16 bp, Artificial sequence
  Synthetic oligonucleotide
ttctgataacgaagag

SEQ ID NO: 1771 - DNA, 16 bp, Artificial sequence
  Synthetic oligonucleotide
atccctaacatgcaat

SEQ ID NO: 1772 - DNA, 16 bp, Artificial sequence
  Synthetic oligonucleotide
ggctcgatggaaaaat

SEQ ID NO: 1773 - DNA, 16 bp, Artificial sequence
  Synthetic oligonucleotide
tctgagtgaagtgtac

SEQ ID NO: 1774 - DNA, 16 bp, Artificial sequence
  Synthetic oligonucleotide
cagcacatcatgctat

SEQ ID NO: 1775 - DNA, 16 bp, Artificial sequence
  Synthetic oligonucleotide
gaagaatcccccccaa

SEQ ID NO: 1776 - DNA, 16 bp, Artificial sequence
  Synthetic oligonucleotide
ccttaaagttacattc

SEQ ID NO: 1777 - DNA, 16 bp, Artificial sequence
  Synthetic oligonucleotide
tcataatctcccacct

SEQ ID NO: 1778 - DNA, 16 bp, Artificial sequence
  Synthetic oligonucleotide
gttaacatgcaaactt

SEQ ID NO: 1779 - DNA, 16 bp, Artificial sequence
  Synthetic oligonucleotide
tccctatataaggtca

SEQ ID NO: 1780 - DNA, 16 bp, Artificial sequence
  Synthetic oligonucleotide
tcactgcaaggtctca

SEQ ID NO: 1781 - DNA, 16 bp, Artificial sequence
  Synthetic oligonucleotide
actgcatttacttgcc

SEQ ID NO: 1782 - DNA, 16 bp, Artificial sequence
  Synthetic oligonucleotide
actactccaagcattg

SEQ ID NO: 1783 - DNA, 16 bp, Artificial sequence
  Synthetic oligonucleotide
cagcttcaatcacaaa

SEQ ID NO: 1784 - DNA, 16 bp, Artificial sequence
  Synthetic oligonucleotide
gtaagaattaagacca

SEQ ID NO: 1785 - DNA, 16 bp, Artificial sequence
  Synthetic oligonucleotide
ttcaactggaagctcc

SEQ ID NO: 1786 - DNA, 16 bp, Artificial sequence
  Synthetic oligonucleotide
gcataaagctgaaatc

SEQ ID NO: 1787 - DNA, 16 bp, Artificial sequence
  Synthetic oligonucleotide
ttgtcctactttaagc

SEQ ID NO: 1788 - DNA, 16 bp, Artificial sequence
  Synthetic oligonucleotide
gagggagttgaggcaa

SEQ ID NO: 1789 - DNA, 16 bp, Artificial sequence
  Synthetic oligonucleotide
aagcaccgcttgagat

SEQ ID NO: 1790 - DNA, 16 bp, Artificial sequence
  Synthetic oligonucleotide
gctagatcaaaaggca

SEQ ID NO: 1791 - DNA, 16 bp, Artificial sequence
  Synthetic oligonucleotide
aaaccgattatggatc

SEQ ID NO: 1792 - DNA, 16 bp, Artificial sequence
  Synthetic oligonucleotide
ggccttttctaacata

SEQ ID NO: 1793 - DNA, 16 bp, Artificial sequence
  Synthetic oligonucleotide
agtcactggataagta

SEQ ID NO: 1794 - DNA, 16 bp, Artificial sequence
  Synthetic oligonucleotide
tccagtctacaagtta

SEQ ID NO: 1795 - DNA, 16 bp, Artificial sequence
  Synthetic oligonucleotide
cagcttccgctaagat

SEQ ID NO: 1796 - DNA, 16 bp, Artificial sequence
  Synthetic oligonucleotide
gaaccccgtcctggaa

SEQ ID NO: 1797 - DNA, 16 bp, Artificial sequence
  Synthetic oligonucleotide
atattgtgctgttacc

SEQ ID NO: 1798 - DNA, 16 bp, Artificial sequence
  Synthetic oligonucleotide
ttatattaggttctcg

SEQ ID NO: 1799 - DNA, 16 bp, Artificial sequence
  Synthetic oligonucleotide
tccccaatcaagattt

SEQ ID NO: 1800 - DNA, 16 bp, Artificial sequence
  Synthetic oligonucleotide
tgtaagaattaagacc

SEQ ID NO: 1801 - DNA, 16 bp, Artificial sequence
  Synthetic oligonucleotide
attcaactggaagctc

SEQ ID NO: 1802 - DNA, 16 bp, Artificial sequence
  Synthetic oligonucleotide
agttaatgtcagccca

SEQ ID NO: 1803 - DNA, 16 bp, Artificial sequence
  Synthetic oligonucleotide
cactactccaagcatt

SEQ ID NO: 1804 - DNA, 16 bp, Artificial sequence
  Synthetic oligonucleotide
ggcaaattaatggcct

SEQ ID NO: 1805 - DNA, 16 bp, Artificial sequence
  Synthetic oligonucleotide
tgcgcttaagagggca

SEQ ID NO: 1806 - DNA, 16 bp, Artificial sequence
  Synthetic oligonucleotide
ggccagcctataagga

SEQ ID NO: 1807 - DNA, 16 bp, Artificial sequence
  Synthetic oligonucleotide
tcagaccttctgaacc

SEQ ID NO: 1808 - DNA, 16 bp, Artificial sequence
  Synthetic oligonucleotide
gtctccgaagacacag

SEQ ID NO: 1809 - DNA, 16 bp, Artificial sequence
  Synthetic oligonucleotide
atggaaagcgagttca

SEQ ID NO: 1810 - DNA, 16 bp, Artificial sequence
  Synthetic oligonucleotide
cgcacggaaatttttc

SEQ ID NO: 1811 - DNA, 16 bp, Artificial sequence
  Synthetic oligonucleotide
cccgcctgagccccgg

SEQ ID NO: 1812 - DNA, 16 bp, Artificial sequence
  Synthetic oligonucleotide
gacttgctcccaagac

SEQ ID NO: 1813 - DNA, 16 bp, Artificial sequence
  Synthetic oligonucleotide
ggacggttgagaagtg

SEQ ID NO: 1814 - DNA, 16 bp, Artificial sequence
  Synthetic oligonucleotide
agattaaagtgtgata

SEQ ID NO: 1815 - DNA, 16 bp, Artificial sequence
  Synthetic oligonucleotide
aaacccccggaacttt

SEQ ID NO: 1816 - DNA, 16 bp, Artificial sequence
  Synthetic oligonucleotide
caaactacacatgcag

SEQ ID NO: 1817 - DNA, 16 bp, Artificial sequence
  Synthetic oligonucleotide
ccgcctttgtgaggga

SEQ ID NO: 1818 - DNA, 16 bp, Artificial sequence
  Synthetic oligonucleotide
atagacggagaacaac

SEQ ID NO: 1819 - DNA, 16 bp, Artificial sequence
  Synthetic oligonucleotide
tgcggtttcctcaagc

SEQ ID NO: 1820 - DNA, 16 bp, Artificial sequence
  Synthetic oligonucleotide
acgctaagcaatatct

SEQ ID NO: 1821 - DNA, 16 bp, Artificial sequence
  Synthetic oligonucleotide
atctaaaagcattgcc

SEQ ID NO: 1822 - DNA, 16 bp, Artificial sequence
  Synthetic oligonucleotide
catggatttcaaggtc

SEQ ID NO: 1823 - DNA, 16 bp, Artificial sequence
  Synthetic oligonucleotide
cttcccgtacttctgt

SEQ ID NO: 1824 - DNA, 16 bp, Artificial sequence
  Synthetic oligonucleotide
attggttaccaataat

SEQ ID NO: 1825 - DNA, 16 bp, Artificial sequence
  Synthetic oligonucleotide
aattacaccagtcctt

SEQ ID NO: 1826 - DNA, 16 bp, Artificial sequence
  Synthetic oligonucleotide
cttgaattacttccgt

SEQ ID NO: 1827 - DNA, 16 bp, Artificial sequence
  Synthetic oligonucleotide
tcaattaatgctagtc

SEQ ID NO: 1828 - DNA, 16 bp, Artificial sequence
  Synthetic oligonucleotide
ctcgcttgctcctcag

SEQ ID NO: 1829 - DNA, 16 bp, Artificial sequence
  Synthetic oligonucleotide
actcgctccttcctgg

SEQ ID NO: 1830 - DNA, 16 bp, Artificial sequence
  Synthetic oligonucleotide
gctcgcctcctccgtg

SEQ ID NO: 1831 - DNA, 16 bp, Artificial sequence
  Synthetic oligonucleotide
acggatttttaccaac

SEQ ID NO: 1832 - DNA, 16 bp, Artificial sequence
  Synthetic oligonucleotide
cgaaactcccccatta

SEQ ID NO: 1833 - DNA, 16 bp, Artificial sequence
  Synthetic oligonucleotide
aacctacaacacccgg

SEQ ID NO: 1834 - DNA, 16 bp, Artificial sequence
  Synthetic oligonucleotide
ctcaatttggctatca

SEQ ID NO: 1835 - DNA, 16 bp, Artificial sequence
  Synthetic oligonucleotide
caaaacgaattcaggg

SEQ ID NO: 1836 - DNA, 16 bp, Artificial sequence
  Synthetic oligonucleotide
ttctagacagacctaa

SEQ ID NO: 1837 - DNA, 16 bp, Artificial sequence
  Synthetic oligonucleotide
ctgtaaacctgtggtg

SEQ ID NO: 1838 - DNA, 16 bp, Artificial sequence
  Synthetic oligonucleotide
ttaagaccatcccaaa

SEQ ID NO: 1839 - DNA, 16 bp, Artificial sequence
  Synthetic oligonucleotide
acagcggtacactcct

SEQ ID NO: 1840 - DNA, 16 bp, Artificial sequence
  Synthetic oligonucleotide
ctgaagttctcctgag

SEQ ID NO: 1841 - DNA, 16 bp, Artificial sequence
  Synthetic oligonucleotide
tcccaaccgtaacagg

SEQ ID NO: 1842 - DNA, 16 bp, Artificial sequence
  Synthetic oligonucleotide
ggagttacttgccaac

SEQ ID NO: 1843 - DNA, 16 bp, Artificial sequence
  Synthetic oligonucleotide
aattaatgcactggta

SEQ ID NO: 1844 - DNA, 16 bp, Artificial sequence
  Synthetic oligonucleotide
tcccttcaggatcatt

SEQ ID NO: 1845 - DNA, 16 bp, Artificial sequence
  Synthetic oligonucleotide
ctgaactatcacaatt

SEQ ID NO: 1846 - DNA, 16 bp, Artificial sequence
  Synthetic oligonucleotide
ccatcatactgccagg

SEQ ID NO: 1847 - DNA, 16 bp, Artificial sequence
  Synthetic oligonucleotide
tgcttattccccaatg

SEQ ID NO: 1848 - DNA, 16 bp, Artificial sequence
  Synthetic oligonucleotide
cgtaactttaaattgg

SEQ ID NO: 1849 - DNA, 16 bp, Artificial sequence
  Synthetic oligonucleotide
agatggacattgcctc

SEQ ID NO: 1850 - DNA, 16 bp, Artificial sequence
  Synthetic oligonucleotide
tcaatccacttgatcc

SEQ ID NO: 1851 - DNA, 16 bp, Artificial sequence
  Synthetic oligonucleotide
cttctgataacgaaga

SEQ ID NO: 1852 - DNA, 16 bp, Artificial sequence
  Synthetic oligonucleotide
ttatccctaacatgca

SEQ ID NO: 1853 - DNA, 16 bp, Artificial sequence
  Synthetic oligonucleotide
aggctcgatggaaaaa

SEQ ID NO: 1854 - DNA, 16 bp, Artificial sequence
  Synthetic oligonucleotide
cactttagaggctttt

SEQ ID NO: 1855 - DNA, 16 bp, Artificial sequence
  Synthetic oligonucleotide
taacagcacatcatgc

SEQ ID NO: 1856 - DNA, 16 bp, Artificial sequence
  Synthetic oligonucleotide
agaagaatccccccca

SEQ ID NO: 1857 - DNA, 16 bp, Artificial sequence
  Synthetic oligonucleotide
gccttaaagttacatt

SEQ ID NO: 1858 - DNA, 16 bp, Artificial sequence
  Synthetic oligonucleotide
atcataatctcccacc

SEQ ID NO: 1859 - DNA, 16 bp, Artificial sequence
  Synthetic oligonucleotide
gattgtaagcatttaa

SEQ ID NO: 1860 - DNA, 16 bp, Artificial sequence
  Synthetic oligonucleotide
ttccctatataaggtc

SEQ ID NO: 1861 - DNA, 16 bp, Artificial sequence
  Synthetic oligonucleotide
taaactcactgcaagg

SEQ ID NO: 1862 - DNA, 16 bp, Artificial sequence
  Synthetic oligonucleotide
tactgcatttacttgc

SEQ ID NO: 1863 - DNA, 16 bp, Artificial sequence
  Synthetic oligonucleotide
atgtactcagcttcaa

SEQ ID NO: 1864 - DNA, 16 bp, Artificial sequence
  Synthetic oligonucleotide
tccagcataaagctga

SEQ ID NO: 1865 - DNA, 16 bp, Artificial sequence
  Synthetic oligonucleotide
ccatggttgtcctact

SEQ ID NO: 1866 - DNA, 16 bp, Artificial sequence
  Synthetic oligonucleotide
agagggagttgaggca

SEQ ID NO: 1867 - DNA, 16 bp, Artificial sequence
  Synthetic oligonucleotide
tcaagcaccgcttgag

SEQ ID NO: 1868 - DNA, 16 bp, Artificial sequence
  Synthetic oligonucleotide
tgctagatcaaaaggc

SEQ ID NO: 1869 - DNA, 16 bp, Artificial sequence
  Synthetic oligonucleotide
gaaaccgattatggat

SEQ ID NO: 1870 - DNA, 16 bp, Artificial sequence
  Synthetic oligonucleotide
ttttagtcactggata

SEQ ID NO: 1871 - DNA, 16 bp, Artificial sequence
  Synthetic oligonucleotide
cctatcttctccagtc

SEQ ID NO: 1872 - DNA, 16 bp, Artificial sequence
  Synthetic oligonucleotide
atcagcttccgctaag

SEQ ID NO: 1873 - DNA, 16 bp, Artificial sequence
  Synthetic oligonucleotide
tgaaccccgtcctgga

SEQ ID NO: 1874 - DNA, 16 bp, Artificial sequence
  Synthetic oligonucleotide
gatattgtgctgttac

SEQ ID NO: 1875 - DNA, 16 bp, Artificial sequence
  Synthetic oligonucleotide
gttatattaggttctc

SEQ ID NO: 1876 - DNA, 16 bp, Artificial sequence
  Synthetic oligonucleotide
tttccccaatcaagat

SEQ ID NO: 1877 - DNA, 16 bp, Artificial sequence
  Synthetic oligonucleotide
ggccatcatactgcca

SEQ ID NO: 1878 - DNA, 16 bp, Artificial sequence
  Synthetic oligonucleotide
ttgaaccccgtcctgg

SEQ ID NO: 1879 - DNA, 16 bp, Artificial sequence
  Synthetic oligonucleotide
ctgcgcttaagagggc

SEQ ID NO: 1880 - DNA, 16 bp, Artificial sequence
  Synthetic oligonucleotide
ggaatggccagcctat

SEQ ID NO: 1881 - DNA, 16 bp, Artificial sequence
  Synthetic oligonucleotide
ttcagaccttctgaac

SEQ ID NO: 1882 - DNA, 16 bp, Artificial sequence
  Synthetic oligonucleotide
atggctttgtctccga

SEQ ID NO: 1883 - DNA, 16 bp, Artificial sequence
  Synthetic oligonucleotide
catggaaagcgagttc

SEQ ID NO: 1884 - DNA, 16 bp, Artificial sequence
  Synthetic oligonucleotide
ccgcacggaaattttt

SEQ ID NO: 1885 - DNA, 16 bp, Artificial sequence
  Synthetic oligonucleotide
ctccccgcctgagccc

SEQ ID NO: 1886 - DNA, 16 bp, Artificial sequence
  Synthetic oligonucleotide
cgacttgctcccaaga

SEQ ID NO: 1887 - DNA, 16 bp, Artificial sequence
  Synthetic oligonucleotide
gggacggttgagaagt

SEQ ID NO: 1888 - DNA, 16 bp, Artificial sequence
  Synthetic oligonucleotide
ggaagattaaagtgtg

SEQ ID NO: 1889 - DNA, 16 bp, Artificial sequence
  Synthetic oligonucleotide
aaaacccccggaactt

SEQ ID NO: 1890 - DNA, 16 bp, Artificial sequence
  Synthetic oligonucleotide
cttgaatgcaaactac

SEQ ID NO: 1891 - DNA, 16 bp, Artificial sequence
  Synthetic oligonucleotide
gccgcctttgtgaggg

SEQ ID NO: 1892 - DNA, 16 bp, Artificial sequence
  Synthetic oligonucleotide
tatagacggagaacaa

SEQ ID NO: 1893 - DNA, 16 bp, Artificial sequence
  Synthetic oligonucleotide
ctgcggtttcctcaag

SEQ ID NO: 1894 - DNA, 16 bp, Artificial sequence
  Synthetic oligonucleotide
gttaaaaacttaacgc

SEQ ID NO: 1895 - DNA, 16 bp, Artificial sequence
  Synthetic oligonucleotide
aatctaaaagcattgc

SEQ ID NO: 1896 - DNA, 16 bp, Artificial sequence
  Synthetic oligonucleotide
tcatggatttcaaggt

SEQ ID NO: 1897 - DNA, 16 bp, Artificial sequence
  Synthetic oligonucleotide
gccttcccgtacttct

SEQ ID NO: 1898 - DNA, 16 bp, Artificial sequence
  Synthetic oligonucleotide
taaattggttaccaat

SEQ ID NO: 1899 - DNA, 16 bp, Artificial sequence
  Synthetic oligonucleotide
aaattacaccagtcct

SEQ ID NO: 1900 - DNA, 16 bp, Artificial sequence
  Synthetic oligonucleotide
tcttgaattacttccg

SEQ ID NO: 1901 - DNA, 16 bp, Artificial sequence
  Synthetic oligonucleotide
gtcaattaatgctagt

SEQ ID NO: 1902 - DNA, 16 bp, Artificial sequence
  Synthetic oligonucleotide
gctcgcttgctcctca

SEQ ID NO: 1903 - DNA, 16 bp, Artificial sequence
  Synthetic oligonucleotide
gcactcgctccttcct

SEQ ID NO: 1904 - DNA, 16 bp, Artificial sequence
  Synthetic oligonucleotide
tgctcgcctcctccgt

SEQ ID NO: 1905 - DNA, 16 bp, Artificial sequence
  Synthetic oligonucleotide
cacggatttttaccaa

SEQ ID NO: 1906 - DNA, 16 bp, Artificial sequence
  Synthetic oligonucleotide
acgaaactcccccatt

SEQ ID NO: 1907 - DNA, 16 bp, Artificial sequence
  Synthetic oligonucleotide
gaaacctacaacaccc

SEQ ID NO: 1908 - DNA, 16 bp, Artificial sequence
  Synthetic oligonucleotide
tctcaatttggctatc

SEQ ID NO: 1909 - DNA, 16 bp, Artificial sequence
  Synthetic oligonucleotide
acaaaacgaattcagg

SEQ ID NO: 1910 - DNA, 16 bp, Artificial sequence
  Synthetic oligonucleotide
attctagacagaccta

SEQ ID NO: 1911 - DNA, 16 bp, Artificial sequence
  Synthetic oligonucleotide
actgtaaacctgtggt

SEQ ID NO: 1912 - DNA, 16 bp, Artificial sequence
  Synthetic oligonucleotide
gttaagaccatcccaa

SEQ ID NO: 1913 - DNA, 16 bp, Artificial sequence
  Synthetic oligonucleotide
cacagcggtacactcc

SEQ ID NO: 1914 - DNA, 16 bp, Artificial sequence
  Synthetic oligonucleotide
gcctactcaagctctt

SEQ ID NO: 1915 - DNA, 16 bp, Artificial sequence
  Synthetic oligonucleotide
atcccaaccgtaacag

SEQ ID NO: 1916 - DNA, 16 bp, Artificial sequence
  Synthetic oligonucleotide
gggagttacttgccaa

SEQ ID NO: 1917 - DNA, 16 bp, Artificial sequence
  Synthetic oligonucleotide
caaattaatgcactgg

SEQ ID NO: 1918 - DNA, 16 bp, Artificial sequence
  Synthetic oligonucleotide
tagttaatgtcagccc

SEQ ID NO: 1919 - DNA, 16 bp, Artificial sequence
  Synthetic oligonucleotide
atcccttcaggatcat

SEQ ID NO: 1920 - DNA, 16 bp, Artificial sequence
  Synthetic oligonucleotide
gctgaactatcacaat

SEQ ID NO: 1921 - DNA, 16 bp, Artificial sequence
  Synthetic oligonucleotide
atgcttattccccaat

SEQ ID NO: 1922 - DNA, 16 bp, Artificial sequence
  Synthetic oligonucleotide
ccgtaactttaaattg

SEQ ID NO: 1923 - DNA, 16 bp, Artificial sequence
  Synthetic oligonucleotide
gagatggacattgcct

SEQ ID NO: 1924 - DNA, 16 bp, Artificial sequence
  Synthetic oligonucleotide
ctcaatccacttgatc

SEQ ID NO: 1925 - DNA, 16 bp, Artificial sequence
  Synthetic oligonucleotide
ctcttctgataacgaa

SEQ ID NO: 1926 - DNA, 16 bp, Artificial sequence
  Synthetic oligonucleotide
cttatccctaacatgc

SEQ ID NO: 1927 - DNA, 16 bp, Artificial sequence
  Synthetic oligonucleotide
aaggctcgatggaaaa

SEQ ID NO: 1928 - DNA, 16 bp, Artificial sequence
  Synthetic oligonucleotide
atcactttagaggctt

SEQ ID NO: 1929 - DNA, 16 bp, Artificial sequence
  Synthetic oligonucleotide
ctaacagcacatcatg

SEQ ID NO: 1930 - DNA, 16 bp, Artificial sequence
  Synthetic oligonucleotide
gagaagaatccccccc

SEQ ID NO: 1931 - DNA, 16 bp, Artificial sequence
  Synthetic oligonucleotide
tgccttaaagttacat

SEQ ID NO: 1932 - DNA, 16 bp, Artificial sequence
  Synthetic oligonucleotide
gatcataatctcccac

SEQ ID NO: 1933 - DNA, 16 bp, Artificial sequence
  Synthetic oligonucleotide
agattgtaagcattta

SEQ ID NO: 1934 - DNA, 16 bp, Artificial sequence
  Synthetic oligonucleotide
cttccctatataaggt

SEQ ID NO: 1935 - DNA, 16 bp, Artificial sequence
  Synthetic oligonucleotide
ctgataaactcactgc

SEQ ID NO: 1936 - DNA, 16 bp, Artificial sequence
  Synthetic oligonucleotide
cagtactgcatttact

SEQ ID NO: 1937 - DNA, 16 bp, Artificial sequence
  Synthetic oligonucleotide
tcactactccaagcat

SEQ ID NO: 1938 - DNA, 16 bp, Artificial sequence
  Synthetic oligonucleotide
aatgtactcagcttca

SEQ ID NO: 1939 - DNA, 16 bp, Artificial sequence
  Synthetic oligonucleotide
gcatgtaagaattaag

SEQ ID NO: 1940 - DNA, 16 bp, Artificial sequence
  Synthetic oligonucleotide
gaattcaactggaagc

SEQ ID NO: 1941 - DNA, 16 bp, Artificial sequence
  Synthetic oligonucleotide
ctccagcataaagctg

SEQ ID NO: 1942 - DNA, 16 bp, Artificial sequence
  Synthetic oligonucleotide
tccatggttgtcctac

SEQ ID NO: 1943 - DNA, 16 bp, Artificial sequence
  Synthetic oligonucleotide
tcggatgcttcactcc

SEQ ID NO: 1944 - DNA, 16 bp, Artificial sequence
  Synthetic oligonucleotide
ttcaagcaccgcttga

SEQ ID NO: 1945 - DNA, 16 bp, Artificial sequence
  Synthetic oligonucleotide
gtgctagatcaaaagg

SEQ ID NO: 1946 - DNA, 16 bp, Artificial sequence
  Synthetic oligonucleotide
tgaaaccgattatgga

SEQ ID NO: 1947 - DNA, 16 bp, Artificial sequence
  Synthetic oligonucleotide
aggcaaattaatggcc

SEQ ID NO: 1948 - DNA, 16 bp, Artificial sequence
  Synthetic oligonucleotide
gttttagtcactggat

SEQ ID NO: 1949 - DNA, 16 bp, Artificial sequence
  Synthetic oligonucleotide
gcctatcttctccagt

SEQ ID NO: 1950 - DNA, 16 bp, Artificial sequence
  Synthetic oligonucleotide
ggagatcagcttccgc

SEQ ID NO: 1951 - DNA, 16 bp, Artificial sequence
  Synthetic oligonucleotide
agatattgtgctgtta

SEQ ID NO: 1952 - DNA, 16 bp, Artificial sequence
  Synthetic oligonucleotide
agttatattaggttct

SEQ ID NO: 1953 - DNA, 16 bp, Artificial sequence
  Synthetic oligonucleotide
cgcctcttaaagcact

SEQ ID NO: 1954 - DNA, 16 bp, Artificial sequence
  Synthetic oligonucleotide
ctggaatggccagcct

SEQ ID NO: 1955 - DNA, 16 bp, Artificial sequence
  Synthetic oligonucleotide
gcacagcggtacactc

SEQ ID NO: 1956 - DNA, 16 bp, Artificial sequence
  Synthetic oligonucleotide
agagaagaatcccccc

SEQ ID NO: 1957 - DNA, 16 bp, Artificial sequence
  Synthetic oligonucleotide
cgctgcgcttaagagg

SEQ ID NO: 1958 - DNA, 16 bp, Artificial sequence
  Synthetic oligonucleotide
tatgagcttcagacct

SEQ ID NO: 1959 - DNA, 16 bp, Artificial sequence
  Synthetic oligonucleotide
gcgaatggctttgtct

SEQ ID NO: 1960 - DNA, 16 bp, Artificial sequence
  Synthetic oligonucleotide
gccatggaaagcgagt

SEQ ID NO: 1961 - DNA, 16 bp, Artificial sequence
  Synthetic oligonucleotide
cccgcacggaaatttt

SEQ ID NO: 1962 - DNA, 16 bp, Artificial sequence
  Synthetic oligonucleotide
gctccccgcctgagcc

SEQ ID NO: 1963 - DNA, 16 bp, Artificial sequence
  Synthetic oligonucleotide
tgcgacttgctcccaa

SEQ ID NO: 1964 - DNA, 16 bp, Artificial sequence
  Synthetic oligonucleotide
agggacggttgagaag

SEQ ID NO: 1965 - DNA, 16 bp, Artificial sequence
  Synthetic oligonucleotide
taccaccttttgaagg

SEQ ID NO: 1966 - DNA, 16 bp, Artificial sequence
  Synthetic oligonucleotide
caaaacccccggaact

SEQ ID NO: 1967 - DNA, 16 bp, Artificial sequence
  Synthetic oligonucleotide
acttgaatgcaaacta

SEQ ID NO: 1968 - DNA, 16 bp, Artificial sequence
  Synthetic oligonucleotide
ccgccgcctttgtgag

SEQ ID NO: 1969 - DNA, 16 bp, Artificial sequence
  Synthetic oligonucleotide
ttatagacggagaaca

SEQ ID NO: 1970 - DNA, 16 bp, Artificial sequence
  Synthetic oligonucleotide
tctgcggtttcctcaa

SEQ ID NO: 1971 - DNA, 16 bp, Artificial sequence
  Synthetic oligonucleotide
cgttaaaaacttaacg

SEQ ID NO: 1972 - DNA, 16 bp, Artificial sequence
  Synthetic oligonucleotide
gtttaagtcaccttca

SEQ ID NO: 1973 - DNA, 16 bp, Artificial sequence
  Synthetic oligonucleotide
gtcatggatttcaagg

SEQ ID NO: 1974 - DNA, 16 bp, Artificial sequence
  Synthetic oligonucleotide
cgccttcccgtacttc

SEQ ID NO: 1975 - DNA, 16 bp, Artificial sequence
  Synthetic oligonucleotide
taaattgatgggcttt

SEQ ID NO: 1976 - DNA, 16 bp, Artificial sequence
  Synthetic oligonucleotide
taaattacaccagtcc

SEQ ID NO: 1977 - DNA, 16 bp, Artificial sequence
  Synthetic oligonucleotide
gatcttgaattacttc

SEQ ID NO: 1978 - DNA, 16 bp, Artificial sequence
  Synthetic oligonucleotide
tgtcaattaatgctag

SEQ ID NO: 1979 - DNA, 16 bp, Artificial sequence
  Synthetic oligonucleotide
ttgctcgcttgctcct

SEQ ID NO: 1980 - DNA, 16 bp, Artificial sequence
  Synthetic oligonucleotide
tgcactcgctccttcc

SEQ ID NO: 1981 - DNA, 16 bp, Artificial sequence
  Synthetic oligonucleotide
ctgctcgcctcctccg

SEQ ID NO: 1982 - DNA, 16 bp, Artificial sequence
  Synthetic oligonucleotide
tcacggatttttacca

SEQ ID NO: 1983 - DNA, 16 bp, Artificial sequence
  Synthetic oligonucleotide
tacgaaactcccccat

SEQ ID NO: 1984 - DNA, 16 bp, Artificial sequence
  Synthetic oligonucleotide
agaaacctacaacacc

SEQ ID NO: 1985 - DNA, 16 bp, Artificial sequence
  Synthetic oligonucleotide
attgtctcaatttggc

SEQ ID NO: 1986 - DNA, 16 bp, Artificial sequence
  Synthetic oligonucleotide
tacaaaacgaattcag

SEQ ID NO: 1987 - DNA, 16 bp, Artificial sequence
  Synthetic oligonucleotide
ggattctagacagacc

SEQ ID NO: 1988 - DNA, 16 bp, Artificial sequence
  Synthetic oligonucleotide
aactgtaaacctgtgg

SEQ ID NO: 1989 - DNA, 16 bp, Artificial sequence
  Synthetic oligonucleotide
tgttaagaccatccca

SEQ ID NO: 1990 - DNA, 16 bp, Artificial sequence
  Synthetic oligonucleotide
ggcctactcaagctct

SEQ ID NO: 1991 - DNA, 16 bp, Artificial sequence
  Synthetic oligonucleotide
caatcccaaccgtaac

SEQ ID NO: 1992 - DNA, 16 bp, Artificial sequence
  Synthetic oligonucleotide
tgggagttacttgcca

SEQ ID NO: 1993 - DNA, 16 bp, Artificial sequence
  Synthetic oligonucleotide
ccaaattaatgcactg

SEQ ID NO: 1994 - DNA, 16 bp, Artificial sequence
  Synthetic oligonucleotide
gtagttaatgtcagcc

SEQ ID NO: 1995 - DNA, 16 bp, Artificial sequence
  Synthetic oligonucleotide
aatcccttcaggatca

SEQ ID NO: 1996 - DNA, 16 bp, Artificial sequence
  Synthetic oligonucleotide
agctgaactatcacaa

SEQ ID NO: 1997 - DNA, 16 bp, Artificial sequence
  Synthetic oligonucleotide
taggccatcatactgc

SEQ ID NO: 1998 - DNA, 16 bp, Artificial sequence
  Synthetic oligonucleotide
ttatgcttattcccca

SEQ ID NO: 1999 - DNA, 16 bp, Artificial sequence
  Synthetic oligonucleotide
tccgtaactttaaatt

SEQ ID NO: 2000 - DNA, 16 bp, Artificial sequence
  Synthetic oligonucleotide
tgagatggacattgcc

SEQ ID NO: 2001 - DNA, 16 bp, Artificial sequence
  Synthetic oligonucleotide
cctcaatccacttgat

SEQ ID NO: 2002 - DNA, 16 bp, Artificial sequence
  Synthetic oligonucleotide
caactcttctgataac

SEQ ID NO: 2003 - DNA, 16 bp, Artificial sequence
  Synthetic oligonucleotide
acttatccctaacatg

SEQ ID NO: 2004 - DNA, 16 bp, Artificial sequence
  Synthetic oligonucleotide
aaaaggctcgatggaa

SEQ ID NO: 2005 - DNA, 16 bp, Artificial sequence
  Synthetic oligonucleotide
gatcactttagaggct

SEQ ID NO: 2006 - DNA, 16 bp, Artificial sequence
  Synthetic oligonucleotide
tctaacagcacatcat

SEQ ID NO: 2007 - DNA, 16 bp, Artificial sequence
  Synthetic oligonucleotide
cctgccttaaagttac

SEQ ID NO: 2008 - DNA, 16 bp, Artificial sequence
  Synthetic oligonucleotide
tgatcataatctccca

SEQ ID NO: 2009 - DNA, 16 bp, Artificial sequence
  Synthetic oligonucleotide
taagattgtaagcatt

SEQ ID NO: 2010 - DNA, 16 bp, Artificial sequence
  Synthetic oligonucleotide
ccttccctatataagg

SEQ ID NO: 2011 - DNA, 16 bp, Artificial sequence
  Synthetic oligonucleotide
gctgataaactcactg

SEQ ID NO: 2012 - DNA, 16 bp, Artificial sequence
  Synthetic oligonucleotide
aacagtactgcattta

SEQ ID NO: 2013 - DNA, 16 bp, Artificial sequence
  Synthetic oligonucleotide
atcactactccaagca

SEQ ID NO: 2014 - DNA, 16 bp, Artificial sequence
  Synthetic oligonucleotide
gcaaaatgtactcagc

SEQ ID NO: 2015 - DNA, 16 bp, Artificial sequence
  Synthetic oligonucleotide
tcctgcatgtaagaat

SEQ ID NO: 2016 - DNA, 16 bp, Artificial sequence
  Synthetic oligonucleotide
tgaattcaactggaag

SEQ ID NO: 2017 - DNA, 16 bp, Artificial sequence
  Synthetic oligonucleotide
gttactccagcataaa

SEQ ID NO: 2018 - DNA, 16 bp, Artificial sequence
  Synthetic oligonucleotide
ctccatggttgtccta

SEQ ID NO: 2019 - DNA, 16 bp, Artificial sequence
  Synthetic oligonucleotide
ttcggatgcttcactc

SEQ ID NO: 2020 - DNA, 16 bp, Artificial sequence
  Synthetic oligonucleotide
cttcaagcaccgcttg

SEQ ID NO: 2021 - DNA, 16 bp, Artificial sequence
  Synthetic oligonucleotide
ctgtgctagatcaaaa

SEQ ID NO: 2022 - DNA, 16 bp, Artificial sequence
  Synthetic oligonucleotide
ttgaaaccgattatgg

SEQ ID NO: 2023 - DNA, 16 bp, Artificial sequence
  Synthetic oligonucleotide
caggcaaattaatggc

SEQ ID NO: 2024 - DNA, 16 bp, Artificial sequence
  Synthetic oligonucleotide
ggttttagtcactgga

SEQ ID NO: 2025 - DNA, 16 bp, Artificial sequence
  Synthetic oligonucleotide
ctcaaatgcctatctt

SEQ ID NO: 2026 - DNA, 16 bp, Artificial sequence
  Synthetic oligonucleotide
tggagatcagcttccg

SEQ ID NO: 2027 - DNA, 16 bp, Artificial sequence
  Synthetic oligonucleotide
tttgaaccccgtcctg

SEQ ID NO: 2028 - DNA, 16 bp, Artificial sequence
  Synthetic oligonucleotide
aagatattgtgctgtt

SEQ ID NO: 2029 - DNA, 16 bp, Artificial sequence
  Synthetic oligonucleotide
cagttatattaggttc

SEQ ID NO: 2030 - DNA, 16 bp, Artificial sequence
  Synthetic oligonucleotide
ccgcctcttaaagcac

SEQ ID NO: 2031 - DNA, 16 bp, Artificial sequence
  Synthetic oligonucleotide
gctgaggcttcccggc

SEQ ID NO: 2032 - DNA, 16 bp, Artificial sequence
  Synthetic oligonucleotide
accacctggaatggcc

SEQ ID NO: 2033 - DNA, 16 bp, Artificial sequence
  Synthetic oligonucleotide
aggtatgagcttcaga

SEQ ID NO: 2034 - DNA, 16 bp, Artificial sequence
  Synthetic oligonucleotide
aagcgaatggctttgt

SEQ ID NO: 2035 - DNA, 16 bp, Artificial sequence
  Synthetic oligonucleotide
tcgccatggaaagcga

SEQ ID NO: 2036 - DNA, 16 bp, Artificial sequence
  Synthetic oligonucleotide
cggcccgcacggaaat

SEQ ID NO: 2037 - DNA, 16 bp, Artificial sequence
  Synthetic oligonucleotide
acagagctgctccccg

SEQ ID NO: 2038 - DNA, 16 bp, Artificial sequence
  Synthetic oligonucleotide
cctgcgacttgctccc

SEQ ID NO: 2039 - DNA, 16 bp, Artificial sequence
  Synthetic oligonucleotide
tgcagggacggttgag

SEQ ID NO: 2040 - DNA, 16 bp, Artificial sequence
  Synthetic oligonucleotide
agtttaccaccttttg

SEQ ID NO: 2041 - DNA, 16 bp, Artificial sequence
  Synthetic oligonucleotide
cacaaaacccccggaa

SEQ ID NO: 2042 - DNA, 16 bp, Artificial sequence
  Synthetic oligonucleotide
atggaacttgaatgca

SEQ ID NO: 2043 - DNA, 16 bp, Artificial sequence
  Synthetic oligonucleotide
caccttccgccgcctt

SEQ ID NO: 2044 - DNA, 16 bp, Artificial sequence
  Synthetic oligonucleotide
atttatagacggagaa

SEQ ID NO: 2045 - DNA, 16 bp, Artificial sequence
  Synthetic oligonucleotide
ttatctgcggtttcct

SEQ ID NO: 2046 - DNA, 16 bp, Artificial sequence
  Synthetic oligonucleotide
ctactcttctaagtct

SEQ ID NO: 2047 - DNA, 16 bp, Artificial sequence
  Synthetic oligonucleotide
ctgtttaagtcacctt

SEQ ID NO: 2048 - DNA, 16 bp, Artificial sequence
  Synthetic oligonucleotide
cgcaattctccctgcg

SEQ ID NO: 2049 - DNA, 16 bp, Artificial sequence
  Synthetic oligonucleotide
cttcgccttcccgtac

SEQ ID NO: 2050 - DNA, 16 bp, Artificial sequence
  Synthetic oligonucleotide
attaaattgatgggct

SEQ ID NO: 2051 - DNA, 16 bp, Artificial sequence
  Synthetic oligonucleotide
ccaaaagccttctgcc

SEQ ID NO: 2052 - DNA, 16 bp, Artificial sequence
  Synthetic oligonucleotide
tactcttgatcttgaa

SEQ ID NO: 2053 - DNA, 16 bp, Artificial sequence
  Synthetic oligonucleotide
agctgtcaattaatgc

SEQ ID NO: 2054 - DNA, 16 bp, Artificial sequence
  Synthetic oligonucleotide
acgaactgctgcttgc

SEQ ID NO: 2055 - DNA, 16 bp, Artificial sequence
  Synthetic oligonucleotide
aattgcactcgctcct

SEQ ID NO: 2056 - DNA, 16 bp, Artificial sequence
  Synthetic oligonucleotide
cctctacgcacaacgc

SEQ ID NO: 2057 - DNA, 16 bp, Artificial sequence
  Synthetic oligonucleotide
cctcacggatttttac

SEQ ID NO: 2058 - DNA, 16 bp, Artificial sequence
  Synthetic oligonucleotide
agtacgaaactccccc

SEQ ID NO: 2059 - DNA, 16 bp, Artificial sequence
  Synthetic oligonucleotide
gagtataagcctgaaa

SEQ ID NO: 2060 - DNA, 16 bp, Artificial sequence
  Synthetic oligonucleotide
gcttacagatttgctg

SEQ ID NO: 2061 - DNA, 16 bp, Artificial sequence
  Synthetic oligonucleotide
ctacatttacaaaacg

SEQ ID NO: 2062 - DNA, 16 bp, Artificial sequence
  Synthetic oligonucleotide
taggattctagacaga

SEQ ID NO: 2063 - DNA, 16 bp, Artificial sequence
  Synthetic oligonucleotide
agaactgctctagttt

SEQ ID NO: 2064 - DNA, 16 bp, Artificial sequence
  Synthetic oligonucleotide
cctgttaagaccatcc

SEQ ID NO: 2065 - DNA, 16 bp, Artificial sequence
  Synthetic oligonucleotide
aacagcacagcggtac

SEQ ID NO: 2066 - DNA, 16 bp, Artificial sequence
  Synthetic oligonucleotide
ttggcctactcaagct

SEQ ID NO: 2067 - DNA, 16 bp, Artificial sequence
  Synthetic oligonucleotide
caccaatcccaaccgt

SEQ ID NO: 2068 - DNA, 16 bp, Artificial sequence
  Synthetic oligonucleotide
attgggagttacttgc

SEQ ID NO: 2069 - DNA, 16 bp, Artificial sequence
  Synthetic oligonucleotide
tgcccaaattaatgca

SEQ ID NO: 2070 - DNA, 16 bp, Artificial sequence
  Synthetic oligonucleotide
attgtagttaatgtca

SEQ ID NO: 2071 - DNA, 16 bp, Artificial sequence
  Synthetic oligonucleotide
catcagaagaaatccc

SEQ ID NO: 2072 - DNA, 16 bp, Artificial sequence
  Synthetic oligonucleotide
attcaagctgaactat

SEQ ID NO: 2073 - DNA, 16 bp, Artificial sequence
  Synthetic oligonucleotide
atctaggccatcatac

SEQ ID NO: 2074 - DNA, 16 bp, Artificial sequence
  Synthetic oligonucleotide
gggttatgcttattcc

SEQ ID NO: 2075 - DNA, 16 bp, Artificial sequence
  Synthetic oligonucleotide
agattccgtaacttta

SEQ ID NO: 2076 - DNA, 16 bp, Artificial sequence
  Synthetic oligonucleotide
cgcttttattctgctt

SEQ ID NO: 2077 - DNA, 16 bp, Artificial sequence
  Synthetic oligonucleotide
gcctcctcaatccact

SEQ ID NO: 2078 - DNA, 16 bp, Artificial sequence
  Synthetic oligonucleotide
ttaacagctgcctgct

SEQ ID NO: 2079 - DNA, 16 bp, Artificial sequence
  Synthetic oligonucleotide
gcacttatccctaaca

SEQ ID NO: 2080 - DNA, 16 bp, Artificial sequence
  Synthetic oligonucleotide
taaaaaggctcgatgg

SEQ ID NO: 2081 - DNA, 16 bp, Artificial sequence
  Synthetic oligonucleotide
cactgatcactttaga

SEQ ID NO: 2082 - DNA, 16 bp, Artificial sequence
  Synthetic oligonucleotide
ctgattctaacagcac

SEQ ID NO: 2083 - DNA, 16 bp, Artificial sequence
  Synthetic oligonucleotide
ttagagaagaatcccc

SEQ ID NO: 2084 - DNA, 16 bp, Artificial sequence
  Synthetic oligonucleotide
attatatgctcatcac

SEQ ID NO: 2085 - DNA, 16 bp, Artificial sequence
  Synthetic oligonucleotide
ctctgatcataatctc

SEQ ID NO: 2086 - DNA, 16 bp, Artificial sequence
  Synthetic oligonucleotide
tctaagattgtaagca

SEQ ID NO: 2087 - DNA, 16 bp, Artificial sequence
  Synthetic oligonucleotide
atgaaatgcctctgca

SEQ ID NO: 2088 - DNA, 16 bp, Artificial sequence
  Synthetic oligonucleotide
gtatgctgataaactc

SEQ ID NO: 2089 - DNA, 16 bp, Artificial sequence
  Synthetic oligonucleotide
atcagaacagtactgc

SEQ ID NO: 2090 - DNA, 16 bp, Artificial sequence
  Synthetic oligonucleotide
acaatcactactccaa

SEQ ID NO: 2091 - DNA, 16 bp, Artificial sequence
  Synthetic oligonucleotide
aaggcttcagtcccct

SEQ ID NO: 2092 - DNA, 16 bp, Artificial sequence
  Synthetic oligonucleotide
tgagtgttcctgcatg

SEQ ID NO: 2093 - DNA, 16 bp, Artificial sequence
  Synthetic oligonucleotide
ggtgaattcaactgga

SEQ ID NO: 2094 - DNA, 16 bp, Artificial sequence
  Synthetic oligonucleotide
cagttactccagcata

SEQ ID NO: 2095 - DNA, 16 bp, Artificial sequence
  Synthetic oligonucleotide
aggaaggctccatggt

SEQ ID NO: 2096 - DNA, 16 bp, Artificial sequence
  Synthetic oligonucleotide
ccttcggatgcttcac

SEQ ID NO: 2097 - DNA, 16 bp, Artificial sequence
  Synthetic oligonucleotide
ccccttcaagcaccgc

SEQ ID NO: 2098 - DNA, 16 bp, Artificial sequence
  Synthetic oligonucleotide
gaagggtctgtgctag

SEQ ID NO: 2099 - DNA, 16 bp, Artificial sequence
  Synthetic oligonucleotide
ccttgaaaccgattat

SEQ ID NO: 2100 - DNA, 16 bp, Artificial sequence
  Synthetic oligonucleotide
tgcaggcaaattaatg

SEQ ID NO: 2101 - DNA, 16 bp, Artificial sequence
  Synthetic oligonucleotide
ggtttaagttggtttt

SEQ ID NO: 2102 - DNA, 16 bp, Artificial sequence
  Synthetic oligonucleotide
agccactcaaatgcct

SEQ ID NO: 2103 - DNA, 16 bp, Artificial sequence
  Synthetic oligonucleotide
gcattggagatcagct

SEQ ID NO: 2104 - DNA, 16 bp, Artificial sequence
  Synthetic oligonucleotide
gatttgaaccccgtcc

SEQ ID NO: 2105 - DNA, 16 bp, Artificial sequence
  Synthetic oligonucleotide
caaagatattgtgctg

SEQ ID NO: 2106 - DNA, 16 bp, Artificial sequence
  Synthetic oligonucleotide
ggcagttatattaggt

SEQ ID NO: 2107 - DNA, 16 bp, Artificial sequence
  Synthetic oligonucleotide
cgccgcctcttaaagc

SEQ ID NO: 2108 - DNA, 16 bp, Artificial sequence
  Synthetic oligonucleotide
tttaggattctagaca

SEQ ID NO: 2109 - DNA, 16 bp, Artificial sequence
  Synthetic oligonucleotide
ttaacaatttgcaggc

SEQ ID NO: 2110 - DNA, 16 bp, Artificial sequence
  Synthetic oligonucleotide
acctaaacccacccca

SEQ ID NO: 2111 - DNA, 16 bp, Artificial sequence
  Synthetic oligonucleotide
aggcgagctgaggctt

SEQ ID NO: 2112 - DNA, 16 bp, Artificial sequence
  Synthetic oligonucleotide
accaccacctggaatg

SEQ ID NO: 2113 - DNA, 16 bp, Artificial sequence
  Synthetic oligonucleotide
ttaggtatgagcttca

SEQ ID NO: 2114 - DNA, 16 bp, Artificial sequence
  Synthetic oligonucleotide
ctaagcgaatggcttt

SEQ ID NO: 2115 - DNA, 16 bp, Artificial sequence
  Synthetic oligonucleotide
aaatcgccatggaaag

SEQ ID NO: 2116 - DNA, 16 bp, Artificial sequence
  Synthetic oligonucleotide
cacggcccgcacggaa

SEQ ID NO: 2117 - DNA, 16 bp, Artificial sequence
  Synthetic oligonucleotide
acgcctcaatcccaca

SEQ ID NO: 2118 - DNA, 16 bp, Artificial sequence
  Synthetic oligonucleotide
agtcctgcgacttgct

SEQ ID NO: 2119 - DNA, 16 bp, Artificial sequence
  Synthetic oligonucleotide
gccttgcagggacggt

SEQ ID NO: 2120 - DNA, 16 bp, Artificial sequence
  Synthetic oligonucleotide
atagtttaccaccttt

SEQ ID NO: 2121 - DNA, 16 bp, Artificial sequence
  Synthetic oligonucleotide
ctcacaaaacccccgg

SEQ ID NO: 2122 - DNA, 16 bp, Artificial sequence
  Synthetic oligonucleotide
ttatggaacttgaatg

SEQ ID NO: 2123 - DNA, 16 bp, Artificial sequence
  Synthetic oligonucleotide
gatcaccttccgccgc

SEQ ID NO: 2124 - DNA, 16 bp, Artificial sequence
  Synthetic oligonucleotide
cgtatttatagacgga

SEQ ID NO: 2125 - DNA, 16 bp, Artificial sequence
  Synthetic oligonucleotide
acttatctgcggtttc

SEQ ID NO: 2126 - DNA, 16 bp, Artificial sequence
  Synthetic oligonucleotide
atgctactcttctaag

SEQ ID NO: 2127 - DNA, 16 bp, Artificial sequence
  Synthetic oligonucleotide
ctttaagctgtttaag

SEQ ID NO: 2128 - DNA, 16 bp, Artificial sequence
  Synthetic oligonucleotide
tgacgcaattctccct

SEQ ID NO: 2129 - DNA, 16 bp, Artificial sequence
  Synthetic oligonucleotide
attcttttcttcgcct

SEQ ID NO: 2130 - DNA, 16 bp, Artificial sequence
  Synthetic oligonucleotide
ctgcaccaccagaaat

SEQ ID NO: 2131 - DNA, 16 bp, Artificial sequence
  Synthetic oligonucleotide
tatttaaggccttcca

SEQ ID NO: 2132 - DNA, 16 bp, Artificial sequence
  Synthetic oligonucleotide
attactcttgatcttg

SEQ ID NO: 2133 - DNA, 16 bp, Artificial sequence
  Synthetic oligonucleotide
cctgggtcagctgtca

SEQ ID NO: 2134 - DNA, 16 bp, Artificial sequence
  Synthetic oligonucleotide
ccacgaactgctgctt

SEQ ID NO: 2135 - DNA, 16 bp, Artificial sequence
  Synthetic oligonucleotide
caaattgcactcgctc

SEQ ID NO: 2136 - DNA, 16 bp, Artificial sequence
  Synthetic oligonucleotide
atcctctacgcacaac

SEQ ID NO: 2137 - DNA, 16 bp, Artificial sequence
  Synthetic oligonucleotide
ccgacctcacggattt

SEQ ID NO: 2138 - DNA, 16 bp, Artificial sequence
  Synthetic oligonucleotide
tcagtacgaaactccc

SEQ ID NO: 2139 - DNA, 16 bp, Artificial sequence
  Synthetic oligonucleotide
atgagtataagcctga

SEQ ID NO: 2140 - DNA, 16 bp, Artificial sequence
  Synthetic oligonucleotide
actgcttacagatttg

SEQ ID NO: 2141 - DNA, 16 bp, Artificial sequence
  Synthetic oligonucleotide
ttacacatccaaactc

SEQ ID NO: 2142 - DNA, 16 bp, Artificial sequence
  Synthetic oligonucleotide
tgagaactgctctagt

SEQ ID NO: 2143 - DNA, 16 bp, Artificial sequence
  Synthetic oligonucleotide
tccctgttaagaccat

SEQ ID NO: 2144 - DNA, 16 bp, Artificial sequence
  Synthetic oligonucleotide
gccaacagcacagcgg

SEQ ID NO: 2145 - DNA, 16 bp, Artificial sequence
  Synthetic oligonucleotide
acatttggcctactca

SEQ ID NO: 2146 - DNA, 16 bp, Artificial sequence
  Synthetic oligonucleotide
tcattgggagttactt

SEQ ID NO: 2147 - DNA, 16 bp, Artificial sequence
  Synthetic oligonucleotide
gacactttccttgccc

SEQ ID NO: 2148 - DNA, 16 bp, Artificial sequence
  Synthetic oligonucleotide
ccataattgtagttaa

SEQ ID NO: 2149 - DNA, 16 bp, Artificial sequence
  Synthetic oligonucleotide
agctaccatcagaaga

SEQ ID NO: 2150 - DNA, 16 bp, Artificial sequence
  Synthetic oligonucleotide
acattcaagctgaact

SEQ ID NO: 2151 - DNA, 16 bp, Artificial sequence
  Synthetic oligonucleotide
ctgcatctaggccatc

SEQ ID NO: 2152 - DNA, 16 bp, Artificial sequence
  Synthetic oligonucleotide
cagggttatgcttatt

SEQ ID NO: 2153 - DNA, 16 bp, Artificial sequence
  Synthetic oligonucleotide
gtagattccgtaactt

SEQ ID NO: 2154 - DNA, 16 bp, Artificial sequence
  Synthetic oligonucleotide
ttcgcttttattctgc

SEQ ID NO: 2155 - DNA, 16 bp, Artificial sequence
  Synthetic oligonucleotide
aacattggcacacagc

SEQ ID NO: 2156 - DNA, 16 bp, Artificial sequence
  Synthetic oligonucleotide
tgttaacagctgcctg

SEQ ID NO: 2157 - DNA, 16 bp, Artificial sequence
  Synthetic oligonucleotide
aagcacttatccctaa

SEQ ID NO: 2158 - DNA, 16 bp, Artificial sequence
  Synthetic oligonucleotide
tttaaaaaggctcgat

SEQ ID NO: 2159 - DNA, 16 bp, Artificial sequence
  Synthetic oligonucleotide
caaggcactgatcact

SEQ ID NO: 2160 - DNA, 16 bp, Artificial sequence
  Synthetic oligonucleotide
aacatctgattctaac

SEQ ID NO: 2161 - DNA, 16 bp, Artificial sequence
  Synthetic oligonucleotide
cgcagacaaagtttct

SEQ ID NO: 2162 - DNA, 16 bp, Artificial sequence
  Synthetic oligonucleotide
gcctggaattattata

SEQ ID NO: 2163 - DNA, 16 bp, Artificial sequence
  Synthetic oligonucleotide
tactctgatcataatc

SEQ ID NO: 2164 - DNA, 16 bp, Artificial sequence
  Synthetic oligonucleotide
actctaagattgtaag

SEQ ID NO: 2165 - DNA, 16 bp, Artificial sequence
  Synthetic oligonucleotide
aggatgaaatgcctct

SEQ ID NO: 2166 - DNA, 16 bp, Artificial sequence
  Synthetic oligonucleotide
tgagtatgctgataaa

SEQ ID NO: 2167 - DNA, 16 bp, Artificial sequence
  Synthetic oligonucleotide
gcgggatcagaacagt

SEQ ID NO: 2168 - DNA, 16 bp, Artificial sequence
  Synthetic oligonucleotide
caacaatcactactcc

SEQ ID NO: 2169 - DNA, 16 bp, Artificial sequence
  Synthetic oligonucleotide
actaaaggcttcagtc

SEQ ID NO: 2170 - DNA, 16 bp, Artificial sequence
  Synthetic oligonucleotide
tggcccttcgcatacg

SEQ ID NO: 2171 - DNA, 16 bp, Artificial sequence
  Synthetic oligonucleotide
ccactggtgaattcaa

SEQ ID NO: 2172 - DNA, 16 bp, Artificial sequence
  Synthetic oligonucleotide
acatgccagttactcc

SEQ ID NO: 2173 - DNA, 16 bp, Artificial sequence
  Synthetic oligonucleotide
tgccacaggaaggctc

SEQ ID NO: 2174 - DNA, 16 bp, Artificial sequence
  Synthetic oligonucleotide
ttccttcggatgcttc

SEQ ID NO: 2175 - DNA, 16 bp, Artificial sequence
  Synthetic oligonucleotide
ctccccttcaagcacc

SEQ ID NO: 2176 - DNA, 16 bp, Artificial sequence
  Synthetic oligonucleotide
gctgcatcgaggtgag

SEQ ID NO: 2177 - DNA, 16 bp, Artificial sequence
  Synthetic oligonucleotide
taccttgaaaccgatt

SEQ ID NO: 2178 - DNA, 16 bp, Artificial sequence
  Synthetic oligonucleotide
tactggtttaagttgg

SEQ ID NO: 2179 - DNA, 16 bp, Artificial sequence
  Synthetic oligonucleotide
caaaagccctctcagc

SEQ ID NO: 2180 - DNA, 16 bp, Artificial sequence
  Synthetic oligonucleotide
gagcattggagatcag

SEQ ID NO: 2181 - DNA, 16 bp, Artificial sequence
  Synthetic oligonucleotide
gggatttgaaccccgt

SEQ ID NO: 2182 - DNA, 16 bp, Artificial sequence
  Synthetic oligonucleotide
tgtatatagttcaaag

SEQ ID NO: 2183 - DNA, 16 bp, Artificial sequence
  Synthetic oligonucleotide
gacaaggcagttatat

SEQ ID NO: 2184 - DNA, 16 bp, Artificial sequence
  Synthetic oligonucleotide
ttccgccgcctcttaa

SEQ ID NO: 2185 - DNA, 16 bp, Artificial sequence
  Synthetic oligonucleotide
agctgaggcttcccgg

SEQ ID NO: 2186 - DNA, 16 bp, Artificial sequence
  Synthetic oligonucleotide
caccacctggaatggc

SEQ ID NO: 2187 - DNA, 16 bp, Artificial sequence
  Synthetic oligonucleotide
taggtatgagcttcag

SEQ ID NO: 2188 - DNA, 16 bp, Artificial sequence
  Synthetic oligonucleotide
taagcgaatggctttg

SEQ ID NO: 2189 - DNA, 16 bp, Artificial sequence
  Synthetic oligonucleotide
aatcgccatggaaagc

SEQ ID NO: 2190 - DNA, 16 bp, Artificial sequence
  Synthetic oligonucleotide
acggcccgcacggaaa

SEQ ID NO: 2191 - DNA, 16 bp, Artificial sequence
  Synthetic oligonucleotide
gcctcaatcccacacc

SEQ ID NO: 2192 - DNA, 16 bp, Artificial sequence
  Synthetic oligonucleotide
tcctgcgacttgctcc

SEQ ID NO: 2193 - DNA, 16 bp, Artificial sequence
  Synthetic oligonucleotide
ttgcagggacggttga

SEQ ID NO: 2194 - DNA, 16 bp, Artificial sequence
  Synthetic oligonucleotide
tagtttaccacctttt

SEQ ID NO: 2195 - DNA, 16 bp, Artificial sequence
  Synthetic oligonucleotide
tcacaaaacccccgga

SEQ ID NO: 2196 - DNA, 16 bp, Artificial sequence
  Synthetic oligonucleotide
tatggaacttgaatgc

SEQ ID NO: 2197 - DNA, 16 bp, Artificial sequence
  Synthetic oligonucleotide
atcaccttccgccgcc

SEQ ID NO: 2198 - DNA, 16 bp, Artificial sequence
  Synthetic oligonucleotide
gtatttatagacggag

SEQ ID NO: 2199 - DNA, 16 bp, Artificial sequence
  Synthetic oligonucleotide
cttatctgcggtttcc

SEQ ID NO: 2200 - DNA, 16 bp, Artificial sequence
  Synthetic oligonucleotide
tgctactcttctaagt

SEQ ID NO: 2201 - DNA, 16 bp, Artificial sequence
  Synthetic oligonucleotide
agctgtttaagtcacc

SEQ ID NO: 2202 - DNA, 16 bp, Artificial sequence
  Synthetic oligonucleotide
gacgcaattctccctg

SEQ ID NO: 2203 - DNA, 16 bp, Artificial sequence
  Synthetic oligonucleotide
ttcttcgccttcccgt

SEQ ID NO: 2204 - DNA, 16 bp, Artificial sequence
  Synthetic oligonucleotide
aattaaattgatgggc

SEQ ID NO: 2205 - DNA, 16 bp, Artificial sequence
  Synthetic oligonucleotide
atttaaggccttccaa

SEQ ID NO: 2206 - DNA, 16 bp, Artificial sequence
  Synthetic oligonucleotide
ttactcttgatcttga

SEQ ID NO: 2207 - DNA, 16 bp, Artificial sequence
  Synthetic oligonucleotide
ctgggtcagctgtcaa

SEQ ID NO: 2208 - DNA, 16 bp, Artificial sequence
  Synthetic oligonucleotide
cacgaactgctgcttg

SEQ ID NO: 2209 - DNA, 16 bp, Artificial sequence
  Synthetic oligonucleotide
aaattgcactcgctcc

SEQ ID NO: 2210 - DNA, 16 bp, Artificial sequence
  Synthetic oligonucleotide
tcctctacgcacaacg

SEQ ID NO: 2211 - DNA, 16 bp, Artificial sequence
  Synthetic oligonucleotide
cgacctcacggatttt

SEQ ID NO: 2212 - DNA, 16 bp, Artificial sequence
  Synthetic oligonucleotide
cagtacgaaactcccc

SEQ ID NO: 2213 - DNA, 16 bp, Artificial sequence
  Synthetic oligonucleotide
tgagtataagcctgaa

SEQ ID NO: 2214 - DNA, 16 bp, Artificial sequence
  Synthetic oligonucleotide
ctgcttacagatttgc

SEQ ID NO: 2215 - DNA, 16 bp, Artificial sequence
  Synthetic oligonucleotide
catccaaactctacat

SEQ ID NO: 2216 - DNA, 16 bp, Artificial sequence
  Synthetic oligonucleotide
ttaggattctagacag

SEQ ID NO: 2217 - DNA, 16 bp, Artificial sequence
  Synthetic oligonucleotide
gagaactgctctagtt

SEQ ID NO: 2218 - DNA, 16 bp, Artificial sequence
  Synthetic oligonucleotide
ccctgttaagaccatc

SEQ ID NO: 2219 - DNA, 16 bp, Artificial sequence
  Synthetic oligonucleotide
caacagcacagcggta

SEQ ID NO: 2220 - DNA, 16 bp, Artificial sequence
  Synthetic oligonucleotide
catttggcctactcaa

SEQ ID NO: 2221 - DNA, 16 bp, Artificial sequence
  Synthetic oligonucleotide
ccaccaatcccaaccg

SEQ ID NO: 2222 - DNA, 16 bp, Artificial sequence
  Synthetic oligonucleotide
cattgggagttacttg

SEQ ID NO: 2223 - DNA, 16 bp, Artificial sequence
  Synthetic oligonucleotide
cactttccttgcccaa

SEQ ID NO: 2224 - DNA, 16 bp, Artificial sequence
  Synthetic oligonucleotide
aattgtagttaatgtc

SEQ ID NO: 2225 - DNA, 16 bp, Artificial sequence
  Synthetic oligonucleotide
gctaccatcagaagaa

SEQ ID NO: 2226 - DNA, 16 bp, Artificial sequence
  Synthetic oligonucleotide
cattcaagctgaacta

SEQ ID NO: 2227 - DNA, 16 bp, Artificial sequence
  Synthetic oligonucleotide
gcatctaggccatcat

SEQ ID NO: 2228 - DNA, 16 bp, Artificial sequence
  Synthetic oligonucleotide
agggttatgcttattc

SEQ ID NO: 2229 - DNA, 16 bp, Artificial sequence
  Synthetic oligonucleotide
tagattccgtaacttt

SEQ ID NO: 2230 - DNA, 16 bp, Artificial sequence
  Synthetic oligonucleotide
tcgcttttattctgct

SEQ ID NO: 2231 - DNA, 16 bp, Artificial sequence
  Synthetic oligonucleotide
cattggcacacagcac

SEQ ID NO: 2232 - DNA, 16 bp, Artificial sequence
  Synthetic oligonucleotide
gttaacagctgcctgc

SEQ ID NO: 2233 - DNA, 16 bp, Artificial sequence
  Synthetic oligonucleotide
agcacttatccctaac

SEQ ID NO: 2234 - DNA, 16 bp, Artificial sequence
  Synthetic oligonucleotide
ttaaaaaggctcgatg

SEQ ID NO: 2235 - DNA, 16 bp, Artificial sequence
  Synthetic oligonucleotide
gcactgatcactttag

SEQ ID NO: 2236 - DNA, 16 bp, Artificial sequence
  Synthetic oligonucleotide
atctgattctaacagc

SEQ ID NO: 2237 - DNA, 16 bp, Artificial sequence
  Synthetic oligonucleotide
gattagagaagaatcc

SEQ ID NO: 2238 - DNA, 16 bp, Artificial sequence
  Synthetic oligonucleotide
ggaattattatatgct

SEQ ID NO: 2239 - DNA, 16 bp, Artificial sequence
  Synthetic oligonucleotide
actctgatcataatct

SEQ ID NO: 2240 - DNA, 16 bp, Artificial sequence
  Synthetic oligonucleotide
ctctaagattgtaagc

SEQ ID NO: 2241 - DNA, 16 bp, Artificial sequence
  Synthetic oligonucleotide
ggatgaaatgcctctg

SEQ ID NO: 2242 - DNA, 16 bp, Artificial sequence
  Synthetic oligonucleotide
gagtatgctgataaac

SEQ ID NO: 2243 - DNA, 16 bp, Artificial sequence
  Synthetic oligonucleotide
cgggatcagaacagta

SEQ ID NO: 2244 - DNA, 16 bp, Artificial sequence
  Synthetic oligonucleotide
aacaatcactactcca

SEQ ID NO: 2245 - DNA, 16 bp, Artificial sequence
  Synthetic oligonucleotide
ctaaaggcttcagtcc

SEQ ID NO: 2246 - DNA, 16 bp, Artificial sequence
  Synthetic oligonucleotide
gctgagtgttcctgca

SEQ ID NO: 2247 - DNA, 16 bp, Artificial sequence
  Synthetic oligonucleotide
tggtgaattcaactgg

SEQ ID NO: 2248 - DNA, 16 bp, Artificial sequence
  Synthetic oligonucleotide
catgccagttactcca

SEQ ID NO: 2249 - DNA, 16 bp, Artificial sequence
  Synthetic oligonucleotide
acaggaaggctccatg

SEQ ID NO: 2250 - DNA, 16 bp, Artificial sequence
  Synthetic oligonucleotide
tccttcggatgcttca

SEQ ID NO: 2251 - DNA, 16 bp, Artificial sequence
  Synthetic oligonucleotide
tccccttcaagcaccg

SEQ ID NO: 2252 - DNA, 16 bp, Artificial sequence
  Synthetic oligonucleotide
tgcatcgaggtgaggg

SEQ ID NO: 2253 - DNA, 16 bp, Artificial sequence
  Synthetic oligonucleotide
accttgaaaccgatta

SEQ ID NO: 2254 - DNA, 16 bp, Artificial sequence
  Synthetic oligonucleotide
taacaatttgcaggca

SEQ ID NO: 2255 - DNA, 16 bp, Artificial sequence
  Synthetic oligonucleotide
ctggtttaagttggtt

SEQ ID NO: 2256 - DNA, 16 bp, Artificial sequence
  Synthetic oligonucleotide
aagccctctcagccac

SEQ ID NO: 2257 - DNA, 16 bp, Artificial sequence
  Synthetic oligonucleotide
agcattggagatcagc

SEQ ID NO: 2258 - DNA, 16 bp, Artificial sequence
  Synthetic oligonucleotide
ggatttgaaccccgtc

SEQ ID NO: 2259 - DNA, 16 bp, Artificial sequence
  Synthetic oligonucleotide
gttcaaagatattgtg

SEQ ID NO: 2260 - DNA, 16 bp, Artificial sequence
  Synthetic oligonucleotide
aggcagttatattagg

SEQ ID NO: 2261 - DNA, 16 bp, Artificial sequence
  Synthetic oligonucleotide
tccgccgcctcttaaa

SEQ ID NO: 2262 - DNA, 16 bp, Artificial sequence
  Synthetic oligonucleotide
gcgccgggcttctgcg

SEQ ID NO: 2263 - DNA, 16 bp, Artificial sequence
  Synthetic oligonucleotide
acctggaatggccagc

SEQ ID NO: 2264 - DNA, 16 bp, Artificial sequence
  Synthetic oligonucleotide
gtatgagcttcagacc

SEQ ID NO: 2265 - DNA, 16 bp, Artificial sequence
  Synthetic oligonucleotide
agcgaatggctttgtc

SEQ ID NO: 2266 - DNA, 16 bp, Artificial sequence
  Synthetic oligonucleotide
cgccatggaaagcgag

SEQ ID NO: 2267 - DNA, 16 bp, Artificial sequence
  Synthetic oligonucleotide
gcccgcacggaaattt

SEQ ID NO: 2268 - DNA, 16 bp, Artificial sequence
  Synthetic oligonucleotide
tgctccccgcctgagc

SEQ ID NO: 2269 - DNA, 16 bp, Artificial sequence
  Synthetic oligonucleotide
ctgcgacttgctccca

SEQ ID NO: 2270 - DNA, 16 bp, Artificial sequence
  Synthetic oligonucleotide
gcagggacggttgaga

SEQ ID NO: 2271 - DNA, 16 bp, Artificial sequence
  Synthetic oligonucleotide
gtttaccaccttttga

SEQ ID NO: 2272 - DNA, 16 bp, Artificial sequence
  Synthetic oligonucleotide
acaaaacccccggaac

SEQ ID NO: 2273 - DNA, 16 bp, Artificial sequence
  Synthetic oligonucleotide
tggaacttgaatgcaa

SEQ ID NO: 2274 - DNA, 16 bp, Artificial sequence
  Synthetic oligonucleotide
ccttccgccgcctttg

SEQ ID NO: 2275 - DNA, 16 bp, Artificial sequence
  Synthetic oligonucleotide
tttatagacggagaac

SEQ ID NO: 2276 - DNA, 16 bp, Artificial sequence
  Synthetic oligonucleotide
atctgcggtttcctca

SEQ ID NO: 2277 - DNA, 16 bp, Artificial sequence
  Synthetic oligonucleotide
agctattaaaattacg

SEQ ID NO: 2278 - DNA, 16 bp, Artificial sequence
  Synthetic oligonucleotide
tgtttaagtcaccttc

SEQ ID NO: 2279 - DNA, 16 bp, Artificial sequence
  Synthetic oligonucleotide
cgtcatggatttcaag

SEQ ID NO: 2280 - DNA, 16 bp, Artificial sequence
  Synthetic oligonucleotide
ttcgccttcccgtact

SEQ ID NO: 2281 - DNA, 16 bp, Artificial sequence
  Synthetic oligonucleotide
ttaaattgatgggctt

SEQ ID NO: 2282 - DNA, 16 bp, Artificial sequence
  Synthetic oligonucleotide
ttaaattacaccagtc

SEQ ID NO: 2283 - DNA, 16 bp, Artificial sequence
  Synthetic oligonucleotide
actcttgatcttgaat

SEQ ID NO: 2284 - DNA, 16 bp, Artificial sequence
  Synthetic oligonucleotide
gctgtcaattaatgct

SEQ ID NO: 2285 - DNA, 16 bp, Artificial sequence
  Synthetic oligonucleotide
cgaactgctgcttgct

SEQ ID NO: 2286 - DNA, 16 bp, Artificial sequence
  Synthetic oligonucleotide
ttgcactcgctccttc

SEQ ID NO: 2287 - DNA, 16 bp, Artificial sequence
  Synthetic oligonucleotide
gcctgctcgcctcctc

SEQ ID NO: 2288 - DNA, 16 bp, Artificial sequence
  Synthetic oligonucleotide
ctcacggatttttacc

SEQ ID NO: 2289 - DNA, 16 bp, Artificial sequence
  Synthetic oligonucleotide
gtacgaaactccccca

SEQ ID NO: 2290 - DNA, 16 bp, Artificial sequence
  Synthetic oligonucleotide
gagaaacctacaacac

SEQ ID NO: 2291 - DNA, 16 bp, Artificial sequence
  Synthetic oligonucleotide
gctgaaattgtctcaa

SEQ ID NO: 2292 - DNA, 16 bp, Artificial sequence
  Synthetic oligonucleotide
ttacaaaacgaattca

SEQ ID NO: 2293 - DNA, 16 bp, Artificial sequence
  Synthetic oligonucleotide
aggattctagacagac

SEQ ID NO: 2294 - DNA, 16 bp, Artificial sequence
  Synthetic oligonucleotide
gctctagtttctataa

SEQ ID NO: 2295 - DNA, 16 bp, Artificial sequence
  Synthetic oligonucleotide
ctgttaagaccatccc

SEQ ID NO: 2296 - DNA, 16 bp, Artificial sequence
  Synthetic oligonucleotide
cagcacagcggtacac

SEQ ID NO: 2297 - DNA, 16 bp, Artificial sequence
  Synthetic oligonucleotide
tggcctactcaagctc

SEQ ID NO: 2298 - DNA, 16 bp, Artificial sequence
  Synthetic oligonucleotide
accaatcccaaccgta

SEQ ID NO: 2299 - DNA, 16 bp, Artificial sequence
  Synthetic oligonucleotide
ttgggagttacttgcc

SEQ ID NO: 2300 - DNA, 16 bp, Artificial sequence
  Synthetic oligonucleotide
cccaaattaatgcact

SEQ ID NO: 2301 - DNA, 16 bp, Artificial sequence
  Synthetic oligonucleotide
tgtagttaatgtcagc

SEQ ID NO: 2302 - DNA, 16 bp, Artificial sequence
  Synthetic oligonucleotide
gaaatcccttcaggat

SEQ ID NO: 2303 - DNA, 16 bp, Artificial sequence
  Synthetic oligonucleotide
caagctgaactatcac

SEQ ID NO: 2304 - DNA, 16 bp, Artificial sequence
  Synthetic oligonucleotide
tctaggccatcatact

SEQ ID NO: 2305 - DNA, 16 bp, Artificial sequence
  Synthetic oligonucleotide
ggttatgcttattccc

SEQ ID NO: 2306 - DNA, 16 bp, Artificial sequence
  Synthetic oligonucleotide
gattccgtaactttaa

SEQ ID NO: 2307 - DNA, 16 bp, Artificial sequence
  Synthetic oligonucleotide
ttgagatggacattgc

SEQ ID NO: 2308 - DNA, 16 bp, Artificial sequence
  Synthetic oligonucleotide
tcctcaatccacttga

SEQ ID NO: 2309 - DNA, 16 bp, Artificial sequence
  Synthetic oligonucleotide
agcaactcttctgata

SEQ ID NO: 2310 - DNA, 16 bp, Artificial sequence
  Synthetic oligonucleotide
cacttatccctaacat

SEQ ID NO: 2311 - DNA, 16 bp, Artificial sequence
  Synthetic oligonucleotide
aaaaaggctcgatgga

SEQ ID NO: 2312 - DNA, 16 bp, Artificial sequence
  Synthetic oligonucleotide
actgatcactttagag

SEQ ID NO: 2313 - DNA, 16 bp, Artificial sequence
  Synthetic oligonucleotide
gattctaacagcacat

SEQ ID NO: 2314 - DNA, 16 bp, Artificial sequence
  Synthetic oligonucleotide
tagagaagaatccccc

SEQ ID NO: 2315 - DNA, 16 bp, Artificial sequence
  Synthetic oligonucleotide
gctcatcactttatga

SEQ ID NO: 2316 - DNA, 16 bp, Artificial sequence
  Synthetic oligonucleotide
tctgatcataatctcc

SEQ ID NO: 2317 - DNA, 16 bp, Artificial sequence
  Synthetic oligonucleotide
ctaagattgtaagcat

SEQ ID NO: 2318 - DNA, 16 bp, Artificial sequence
  Synthetic oligonucleotide
cccttccctatataag

SEQ ID NO: 2319 - DNA, 16 bp, Artificial sequence
  Synthetic oligonucleotide
tgctgataaactcact

SEQ ID NO: 2320 - DNA, 16 bp, Artificial sequence
  Synthetic oligonucleotide
gaacagtactgcattt

SEQ ID NO: 2321 - DNA, 16 bp, Artificial sequence
  Synthetic oligonucleotide
aatcactactccaagc

SEQ ID NO: 2322 - DNA, 16 bp, Artificial sequence
  Synthetic oligonucleotide
ccagcaaaatgtactc

SEQ ID NO: 2323 - DNA, 16 bp, Artificial sequence
  Synthetic oligonucleotide
agtgttcctgcatgta

SEQ ID NO: 2324 - DNA, 16 bp, Artificial sequence
  Synthetic oligonucleotide
gtgaattcaactggaa

SEQ ID NO: 2325 - DNA, 16 bp, Artificial sequence
  Synthetic oligonucleotide
agttactccagcataa

SEQ ID NO: 2326 - DNA, 16 bp, Artificial sequence
  Synthetic oligonucleotide
aaggctccatggttgt

SEQ ID NO: 2327 - DNA, 16 bp, Artificial sequence
  Synthetic oligonucleotide
cttcggatgcttcact

SEQ ID NO: 2328 - DNA, 16 bp, Artificial sequence
  Synthetic oligonucleotide
cccttcaagcaccgct

SEQ ID NO: 2329 - DNA, 16 bp, Artificial sequence
  Synthetic oligonucleotide
tctgtgctagatcaaa

SEQ ID NO: 2330 - DNA, 16 bp, Artificial sequence
  Synthetic oligonucleotide
cttgaaaccgattatg

SEQ ID NO: 2331 - DNA, 16 bp, Artificial sequence
  Synthetic oligonucleotide
gcaggcaaattaatgg

SEQ ID NO: 2332 - DNA, 16 bp, Artificial sequence
  Synthetic oligonucleotide
taagttggttttagtc

SEQ ID NO: 2333 - DNA, 16 bp, Artificial sequence
  Synthetic oligonucleotide
gccactcaaatgccta

SEQ ID NO: 2334 - DNA, 16 bp, Artificial sequence
  Synthetic oligonucleotide
attggagatcagcttc

SEQ ID NO: 2335 - DNA, 16 bp, Artificial sequence
  Synthetic oligonucleotide
atttgaaccccgtcct

SEQ ID NO: 2336 - DNA, 16 bp, Artificial sequence
  Synthetic oligonucleotide
aaagatattgtgctgt

SEQ ID NO: 2337 - DNA, 16 bp, Artificial sequence
  Synthetic oligonucleotide
gcagttatattaggtt

SEQ ID NO: 2338 - DNA, 16 bp, Artificial sequence
  Synthetic oligonucleotide
gccgcctcttaaagca

SEQ ID NO: 2339 - DNA, 16 bp, Artificial sequence
  Synthetic oligonucleotide
gactaaaggcttcagt

SEQ ID NO: 2340 - DNA, 16 bp, Artificial sequence
  Synthetic oligonucleotide
caaactgcttacagat

SEQ ID NO: 2341 - DNA, 16 bp, Artificial sequence
  Synthetic oligonucleotide
caggcgagctgaggct

SEQ ID NO: 2342 - DNA, 16 bp, Artificial sequence
  Synthetic oligonucleotide
taaataccaccacctg

SEQ ID NO: 2343 - DNA, 16 bp, Artificial sequence
  Synthetic oligonucleotide
gttaggtatgagcttc

SEQ ID NO: 2344 - DNA, 16 bp, Artificial sequence
  Synthetic oligonucleotide
actaagcgaatggctt

SEQ ID NO: 2345 - DNA, 16 bp, Artificial sequence
  Synthetic oligonucleotide
caaatcgccatggaaa

SEQ ID NO: 2346 - DNA, 16 bp, Artificial sequence
  Synthetic oligonucleotide
ccacggcccgcacgga

SEQ ID NO: 2347 - DNA, 16 bp, Artificial sequence
  Synthetic oligonucleotide
ccactcttggaaaacg

SEQ ID NO: 2348 - DNA, 16 bp, Artificial sequence
  Synthetic oligonucleotide
tgcagtcctgcgactt

SEQ ID NO: 2349 - DNA, 16 bp, Artificial sequence
  Synthetic oligonucleotide
agccttgcagggacgg

SEQ ID NO: 2350 - DNA, 16 bp, Artificial sequence
  Synthetic oligonucleotide
tatagtttaccacctt

SEQ ID NO: 2351 - DNA, 16 bp, Artificial sequence
  Synthetic oligonucleotide
cctcacaaaacccccg

SEQ ID NO: 2352 - DNA, 16 bp, Artificial sequence
  Synthetic oligonucleotide
cttatggaacttgaat

SEQ ID NO: 2353 - DNA, 16 bp, Artificial sequence
  Synthetic oligonucleotide
ttcgatcaccttccgc

SEQ ID NO: 2354 - DNA, 16 bp, Artificial sequence
  Synthetic oligonucleotide
cagctcgggcgaggcg

SEQ ID NO: 2355 - DNA, 16 bp, Artificial sequence
  Synthetic oligonucleotide
aacttatctgcggttt

SEQ ID NO: 2356 - DNA, 16 bp, Artificial sequence
  Synthetic oligonucleotide
cctcatgctactcttc

SEQ ID NO: 2357 - DNA, 16 bp, Artificial sequence
  Synthetic oligonucleotide
aatcacctacaacttt

SEQ ID NO: 2358 - DNA, 16 bp, Artificial sequence
  Synthetic oligonucleotide
atgacgcaattctccc

SEQ ID NO: 2359 - DNA, 16 bp, Artificial sequence
  Synthetic oligonucleotide
tattcttttcttcgcc

SEQ ID NO: 2360 - DNA, 16 bp, Artificial sequence
  Synthetic oligonucleotide
cttctgcaccaccaga

SEQ ID NO: 2361 - DNA, 16 bp, Artificial sequence
  Synthetic oligonucleotide
tatatttaaggccttc

SEQ ID NO: 2362 - DNA, 16 bp, Artificial sequence
  Synthetic oligonucleotide
aattactcttgatctt

SEQ ID NO: 2363 - DNA, 16 bp, Artificial sequence
  Synthetic oligonucleotide
acctgggtcagctgtc

SEQ ID NO: 2364 - DNA, 16 bp, Artificial sequence
  Synthetic oligonucleotide
accacgaactgctgct

SEQ ID NO: 2365 - DNA, 16 bp, Artificial sequence
  Synthetic oligonucleotide
ccaaattgcactcgct

SEQ ID NO: 2366 - DNA, 16 bp, Artificial sequence
  Synthetic oligonucleotide
ggatcctctacgcaca

SEQ ID NO: 2367 - DNA, 16 bp, Artificial sequence
  Synthetic oligonucleotide
gccgacctcacggatt

SEQ ID NO: 2368 - DNA, 16 bp, Artificial sequence
  Synthetic oligonucleotide
ctcagtacgaaactcc

SEQ ID NO: 2369 - DNA, 16 bp, Artificial sequence
  Synthetic oligonucleotide
catgagtataagcctg

SEQ ID NO: 2370 - DNA, 16 bp, Artificial sequence
  Synthetic oligonucleotide
cagttacacatccaaa

SEQ ID NO: 2371 - DNA, 16 bp, Artificial sequence
  Synthetic oligonucleotide
ctttaggattctagac

SEQ ID NO: 2372 - DNA, 16 bp, Artificial sequence
  Synthetic oligonucleotide
gtgagaactgctctag

SEQ ID NO: 2373 - DNA, 16 bp, Artificial sequence
  Synthetic oligonucleotide
tatagcatctgtggaa

SEQ ID NO: 2374 - DNA, 16 bp, Artificial sequence
  Synthetic oligonucleotide
tgccaacagcacagcg

SEQ ID NO: 2375 - DNA, 16 bp, Artificial sequence
  Synthetic oligonucleotide
aacatttggcctactc

SEQ ID NO: 2376 - DNA, 16 bp, Artificial sequence
  Synthetic oligonucleotide
tacctaaacccacccc

SEQ ID NO: 2377 - DNA, 16 bp, Artificial sequence
  Synthetic oligonucleotide
atcattgggagttact

SEQ ID NO: 2378 - DNA, 16 bp, Artificial sequence
  Synthetic oligonucleotide
tgacactttccttgcc

SEQ ID NO: 2379 - DNA, 16 bp, Artificial sequence
  Synthetic oligonucleotide
cccataattgtagtta

SEQ ID NO: 2380 - DNA, 16 bp, Artificial sequence
  Synthetic oligonucleotide
tacaaaagctaccatc

SEQ ID NO: 2381 - DNA, 16 bp, Artificial sequence
  Synthetic oligonucleotide
gacattcaagctgaac

SEQ ID NO: 2382 - DNA, 16 bp, Artificial sequence
  Synthetic oligonucleotide
ctctgcatctaggcca

SEQ ID NO: 2383 - DNA, 16 bp, Artificial sequence
  Synthetic oligonucleotide
tcagggttatgcttat

SEQ ID NO: 2384 - DNA, 16 bp, Artificial sequence
  Synthetic oligonucleotide
ggtagattccgtaact

SEQ ID NO: 2385 - DNA, 16 bp, Artificial sequence
  Synthetic oligonucleotide
taatgtagtgtaacat

SEQ ID NO: 2386 - DNA, 16 bp, Artificial sequence
  Synthetic oligonucleotide
acgaaacattggcaca

SEQ ID NO: 2387 - DNA, 16 bp, Artificial sequence
  Synthetic oligonucleotide
ctgttaacagctgcct

SEQ ID NO: 2388 - DNA, 16 bp, Artificial sequence
  Synthetic oligonucleotide
ataagcacttatccct

SEQ ID NO: 2389 - DNA, 16 bp, Artificial sequence
  Synthetic oligonucleotide
ttttaaaaaggctcga

SEQ ID NO: 2390 - DNA, 16 bp, Artificial sequence
  Synthetic oligonucleotide
tcaaggcactgatcac

SEQ ID NO: 2391 - DNA, 16 bp, Artificial sequence
  Synthetic oligonucleotide
cagtaacatctgattc

SEQ ID NO: 2392 - DNA, 16 bp, Artificial sequence
  Synthetic oligonucleotide
tcgcagacaaagtttc

SEQ ID NO: 2393 - DNA, 16 bp, Artificial sequence
  Synthetic oligonucleotide
gtgcctggaattatta

SEQ ID NO: 2394 - DNA, 16 bp, Artificial sequence
  Synthetic oligonucleotide
ccttttactctgatca

SEQ ID NO: 2395 - DNA, 16 bp, Artificial sequence
  Synthetic oligonucleotide
cactctaagattgtaa

SEQ ID NO: 2396 - DNA, 16 bp, Artificial sequence
  Synthetic oligonucleotide
gaaggatgaaatgcct

SEQ ID NO: 2397 - DNA, 16 bp, Artificial sequence
  Synthetic oligonucleotide
ttgagtatgctgataa

SEQ ID NO: 2398 - DNA, 16 bp, Artificial sequence
  Synthetic oligonucleotide
agcgggatcagaacag

SEQ ID NO: 2399 - DNA, 16 bp, Artificial sequence
  Synthetic oligonucleotide
tcaacaatcactactc

SEQ ID NO: 2400 - DNA, 16 bp, Artificial sequence
  Synthetic oligonucleotide
cttactgggtctggct

SEQ ID NO: 2401 - DNA, 16 bp, Artificial sequence
  Synthetic oligonucleotide
attttgtccactggtg

SEQ ID NO: 2402 - DNA, 16 bp, Artificial sequence
  Synthetic oligonucleotide
ctcacatgccagttac

SEQ ID NO: 2403 - DNA, 16 bp, Artificial sequence
  Synthetic oligonucleotide
gctttgttgtctctcc

SEQ ID NO: 2404 - DNA, 16 bp, Artificial sequence
  Synthetic oligonucleotide
cattccttcggatgct

SEQ ID NO: 2405 - DNA, 16 bp, Artificial sequence
  Synthetic oligonucleotide
gcccgctttccccctt

SEQ ID NO: 2406 - DNA, 16 bp, Artificial sequence
  Synthetic oligonucleotide
ctactggctgcatcga

SEQ ID NO: 2407 - DNA, 16 bp, Artificial sequence
  Synthetic oligonucleotide
ttaccttgaaaccgat

SEQ ID NO: 2408 - DNA, 16 bp, Artificial sequence
  Synthetic oligonucleotide
gttaacaatttgcagg

SEQ ID NO: 2409 - DNA, 16 bp, Artificial sequence
  Synthetic oligonucleotide
ttactggtttaagttg

SEQ ID NO: 2410 - DNA, 16 bp, Artificial sequence
  Synthetic oligonucleotide
cccaaaagccctctca

SEQ ID NO: 2411 - DNA, 16 bp, Artificial sequence
  Synthetic oligonucleotide
agagcattggagatca

SEQ ID NO: 2412 - DNA, 16 bp, Artificial sequence
  Synthetic oligonucleotide
agggatttgaaccccg

SEQ ID NO: 2413 - DNA, 16 bp, Artificial sequence
  Synthetic oligonucleotide
gatgtatatagttcaa

SEQ ID NO: 2414 - DNA, 16 bp, Artificial sequence
  Synthetic oligonucleotide
ggctattacctgaaaa

SEQ ID NO: 2415 - DNA, 16 bp, Artificial sequence
  Synthetic oligonucleotide
cttccgccgcctctta

SEQ ID NO: 2416 - DNA, 16 bp, Artificial sequence
  Synthetic oligonucleotide
tcttactgggtctggc

SEQ ID NO: 2417 - DNA, 16 bp, Artificial sequence
  Synthetic oligonucleotide
tcaggcgagctgaggc

SEQ ID NO: 2418 - DNA, 16 bp, Artificial sequence
  Synthetic oligonucleotide
ctaaataccaccacct

SEQ ID NO: 2419 - DNA, 16 bp, Artificial sequence
  Synthetic oligonucleotide
ggttaggtatgagctt

SEQ ID NO: 2420 - DNA, 16 bp, Artificial sequence
  Synthetic oligonucleotide
caactaagcgaatggc

SEQ ID NO: 2421 - DNA, 16 bp, Artificial sequence
  Synthetic oligonucleotide
gcaaatcgccatggaa

SEQ ID NO: 2422 - DNA, 16 bp, Artificial sequence
  Synthetic oligonucleotide
cccacggcccgcacgg

SEQ ID NO: 2423 - DNA, 16 bp, Artificial sequence
  Synthetic oligonucleotide
gaaaacccactcttgg

SEQ ID NO: 2424 - DNA, 16 bp, Artificial sequence
  Synthetic oligonucleotide
aactgcttgcagtcct

SEQ ID NO: 2425 - DNA, 16 bp, Artificial sequence
  Synthetic oligonucleotide
cgcaactgagccccag

SEQ ID NO: 2426 - DNA, 16 bp, Artificial sequence
  Synthetic oligonucleotide
gtatagtttaccacct

SEQ ID NO: 2427 - DNA, 16 bp, Artificial sequence
  Synthetic oligonucleotide
tcatcaaacacctcac

SEQ ID NO: 2428 - DNA, 16 bp, Artificial sequence
  Synthetic oligonucleotide
gcttatggaacttgaa

SEQ ID NO: 2429 - DNA, 16 bp, Artificial sequence
  Synthetic oligonucleotide
attcgatcaccttccg

SEQ ID NO: 2430 - DNA, 16 bp, Artificial sequence
  Synthetic oligonucleotide
cacagctcgggcgagg

SEQ ID NO: 2431 - DNA, 16 bp, Artificial sequence
  Synthetic oligonucleotide
aaacttatctgcggtt

SEQ ID NO: 2432 - DNA, 16 bp, Artificial sequence
  Synthetic oligonucleotide
ccgtcatgttttagaa

SEQ ID NO: 2433 - DNA, 16 bp, Artificial sequence
  Synthetic oligonucleotide
tcgccttcaaattatt

SEQ ID NO: 2434 - DNA, 16 bp, Artificial sequence
  Synthetic oligonucleotide
aatgacgcaattctcc

SEQ ID NO: 2435 - DNA, 16 bp, Artificial sequence
  Synthetic oligonucleotide
ctattcttttcttcgc

SEQ ID NO: 2436 - DNA, 16 bp, Artificial sequence
  Synthetic oligonucleotide
ctaacttctgcaccac

SEQ ID NO: 2437 - DNA, 16 bp, Artificial sequence
  Synthetic oligonucleotide
ctatatttaaggcctt

SEQ ID NO: 2438 - DNA, 16 bp, Artificial sequence
  Synthetic oligonucleotide
taattactcttgatct

SEQ ID NO: 2439 - DNA, 16 bp, Artificial sequence
  Synthetic oligonucleotide
cacctgggtcagctgt

SEQ ID NO: 2440 - DNA, 16 bp, Artificial sequence
  Synthetic oligonucleotide
caccacgaactgctgc

SEQ ID NO: 2441 - DNA, 16 bp, Artificial sequence
  Synthetic oligonucleotide
accaaattgcactcgc

SEQ ID NO: 2442 - DNA, 16 bp, Artificial sequence
  Synthetic oligonucleotide
taggatcctctacgca

SEQ ID NO: 2443 - DNA, 16 bp, Artificial sequence
  Synthetic oligonucleotide
tgccgacctcacggat

SEQ ID NO: 2444 - DNA, 16 bp, Artificial sequence
  Synthetic oligonucleotide
cctcagtacgaaactc

SEQ ID NO: 2445 - DNA, 16 bp, Artificial sequence
  Synthetic oligonucleotide
attcatgagtataagc

SEQ ID NO: 2446 - DNA, 16 bp, Artificial sequence
  Synthetic oligonucleotide
acaaactgcttacaga

SEQ ID NO: 2447 - DNA, 16 bp, Artificial sequence
  Synthetic oligonucleotide
ctcagttacacatcca

SEQ ID NO: 2448 - DNA, 16 bp, Artificial sequence
  Synthetic oligonucleotide
gcctttaggattctag

SEQ ID NO: 2449 - DNA, 16 bp, Artificial sequence
  Synthetic oligonucleotide
cgtgagaactgctcta

SEQ ID NO: 2450 - DNA, 16 bp, Artificial sequence
  Synthetic oligonucleotide
ctatagcatctgtgga

SEQ ID NO: 2451 - DNA, 16 bp, Artificial sequence
  Synthetic oligonucleotide
tccctgaaggtgttcg

SEQ ID NO: 2452 - DNA, 16 bp, Artificial sequence
  Synthetic oligonucleotide
caacatttggcctact

SEQ ID NO: 2453 - DNA, 16 bp, Artificial sequence
  Synthetic oligonucleotide
ttacctaaacccaccc

SEQ ID NO: 2454 - DNA, 16 bp, Artificial sequence
  Synthetic oligonucleotide
aatcattgggagttac

SEQ ID NO: 2455 - DNA, 16 bp, Artificial sequence
  Synthetic oligonucleotide
tatgacactttccttg

SEQ ID NO: 2456 - DNA, 16 bp, Artificial sequence
  Synthetic oligonucleotide
tcccataattgtagtt

SEQ ID NO: 2457 - DNA, 16 bp, Artificial sequence
  Synthetic oligonucleotide
cttacttgataataca

SEQ ID NO: 2458 - DNA, 16 bp, Artificial sequence
  Synthetic oligonucleotide
taagagacattcaagc

SEQ ID NO: 2459 - DNA, 16 bp, Artificial sequence
  Synthetic oligonucleotide
tcaccaaggagctgtt

SEQ ID NO: 2460 - DNA, 16 bp, Artificial sequence
  Synthetic oligonucleotide
ctcagggttatgctta

SEQ ID NO: 2461 - DNA, 16 bp, Artificial sequence
  Synthetic oligonucleotide
atggtagattccgtaa

SEQ ID NO: 2462 - DNA, 16 bp, Artificial sequence
  Synthetic oligonucleotide
ttaatgtagtgtaaca

SEQ ID NO: 2463 - DNA, 16 bp, Artificial sequence
  Synthetic oligonucleotide
aacgaaacattggcac

SEQ ID NO: 2464 - DNA, 16 bp, Artificial sequence
  Synthetic oligonucleotide
tctgttaacagctgcc

SEQ ID NO: 2465 - DNA, 16 bp, Artificial sequence
  Synthetic oligonucleotide
aataagcacttatccc

SEQ ID NO: 2466 - DNA, 16 bp, Artificial sequence
  Synthetic oligonucleotide
attttaaaaaggctcg

SEQ ID NO: 2467 - DNA, 16 bp, Artificial sequence
  Synthetic oligonucleotide
atcaaggcactgatca

SEQ ID NO: 2468 - DNA, 16 bp, Artificial sequence
  Synthetic oligonucleotide
gcagtaacatctgatt

SEQ ID NO: 2469 - DNA, 16 bp, Artificial sequence
  Synthetic oligonucleotide
ttcgcagacaaagttt

SEQ ID NO: 2470 - DNA, 16 bp, Artificial sequence
  Synthetic oligonucleotide
catgtgcctggaatta

SEQ ID NO: 2471 - DNA, 16 bp, Artificial sequence
  Synthetic oligonucleotide
accttttactctgatc

SEQ ID NO: 2472 - DNA, 16 bp, Artificial sequence
  Synthetic oligonucleotide
ccactctaagattgta

SEQ ID NO: 2473 - DNA, 16 bp, Artificial sequence
  Synthetic oligonucleotide
tgaaggatgaaatgcc

SEQ ID NO: 2474 - DNA, 16 bp, Artificial sequence
  Synthetic oligonucleotide
tttgagtatgctgata

SEQ ID NO: 2475 - DNA, 16 bp, Artificial sequence
  Synthetic oligonucleotide
cagcgggatcagaaca

SEQ ID NO: 2476 - DNA, 16 bp, Artificial sequence
  Synthetic oligonucleotide
cttcaacaatcactac

SEQ ID NO: 2477 - DNA, 16 bp, Artificial sequence
  Synthetic oligonucleotide
agactaaaggcttcag

SEQ ID NO: 2478 - DNA, 16 bp, Artificial sequence
  Synthetic oligonucleotide
agcttgttcacctgtt

SEQ ID NO: 2479 - DNA, 16 bp, Artificial sequence
  Synthetic oligonucleotide
gctcacatgccagtta

SEQ ID NO: 2480 - DNA, 16 bp, Artificial sequence
  Synthetic oligonucleotide
cgctttgttgtctctc

SEQ ID NO: 2481 - DNA, 16 bp, Artificial sequence
  Synthetic oligonucleotide
agcattccttcggatg

SEQ ID NO: 2482 - DNA, 16 bp, Artificial sequence
  Synthetic oligonucleotide
ttgcccgctttccccc

SEQ ID NO: 2483 - DNA, 16 bp, Artificial sequence
  Synthetic oligonucleotide
gctactggctgcatcg

SEQ ID NO: 2484 - DNA, 16 bp, Artificial sequence
  Synthetic oligonucleotide
gttaccttgaaaccga

SEQ ID NO: 2485 - DNA, 16 bp, Artificial sequence
  Synthetic oligonucleotide
tgttaacaatttgcag

SEQ ID NO: 2486 - DNA, 16 bp, Artificial sequence
  Synthetic oligonucleotide
acttactggtttaagt

SEQ ID NO: 2487 - DNA, 16 bp, Artificial sequence
  Synthetic oligonucleotide
acccaaaagccctctc

SEQ ID NO: 2488 - DNA, 16 bp, Artificial sequence
  Synthetic oligonucleotide
aagagcattggagatc

SEQ ID NO: 2489 - DNA, 16 bp, Artificial sequence
  Synthetic oligonucleotide
cgcagggatttgaacc

SEQ ID NO: 2490 - DNA, 16 bp, Artificial sequence
  Synthetic oligonucleotide
ggatgtatatagttca

SEQ ID NO: 2491 - DNA, 16 bp, Artificial sequence
  Synthetic oligonucleotide
aggctattacctgaaa

SEQ ID NO: 2492 - DNA, 16 bp, Artificial sequence
  Synthetic oligonucleotide
ccttccgccgcctctt

SEQ ID NO: 2493 - DNA, 16 bp, Artificial sequence
  Synthetic oligonucleotide
gtaattactcttgatc

SEQ ID NO: 2494 - DNA, 16 bp, Artificial sequence
  Synthetic oligonucleotide
cttcaggcgagctgag

SEQ ID NO: 2495 - DNA, 16 bp, Artificial sequence
  Synthetic oligonucleotide
ttatctaaataccacc

SEQ ID NO: 2496 - DNA, 16 bp, Artificial sequence
  Synthetic oligonucleotide
tggttaggtatgagct

SEQ ID NO: 2497 - DNA, 16 bp, Artificial sequence
  Synthetic oligonucleotide
ccaactaagcgaatgg

SEQ ID NO: 2498 - DNA, 16 bp, Artificial sequence
  Synthetic oligonucleotide
ggcaaatcgccatgga

SEQ ID NO: 2499 - DNA, 16 bp, Artificial sequence
  Synthetic oligonucleotide
ccccacggcccgcacg

SEQ ID NO: 2500 - DNA, 16 bp, Artificial sequence
  Synthetic oligonucleotide
tgaaaacccactcttg

SEQ ID NO: 2501 - DNA, 16 bp, Artificial sequence
  Synthetic oligonucleotide
ccaactgcttgcagtc

SEQ ID NO: 2502 - DNA, 16 bp, Artificial sequence
  Synthetic oligonucleotide
acgcaactgagcccca

SEQ ID NO: 2503 - DNA, 16 bp, Artificial sequence
  Synthetic oligonucleotide
aggtatagtttaccac

SEQ ID NO: 2504 - DNA, 16 bp, Artificial sequence
  Synthetic oligonucleotide
acgggtcatcaaacac

SEQ ID NO: 2505 - DNA, 16 bp, Artificial sequence
  Synthetic oligonucleotide
agcttatggaacttga

SEQ ID NO: 2506 - DNA, 16 bp, Artificial sequence
  Synthetic oligonucleotide
aattcgatcaccttcc

SEQ ID NO: 2507 - DNA, 16 bp, Artificial sequence
  Synthetic oligonucleotide
gcacagctcgggcgag

SEQ ID NO: 2508 - DNA, 16 bp, Artificial sequence
  Synthetic oligonucleotide
aaaacttatctgcggt

SEQ ID NO: 2509 - DNA, 16 bp, Artificial sequence
  Synthetic oligonucleotide
tccgtcatgttttaga

SEQ ID NO: 2510 - DNA, 16 bp, Artificial sequence
  Synthetic oligonucleotide
atcgccttcaaattat

SEQ ID NO: 2511 - DNA, 16 bp, Artificial sequence
  Synthetic oligonucleotide
taaatgacgcaattct

SEQ ID NO: 2512 - DNA, 16 bp, Artificial sequence
  Synthetic oligonucleotide
gcttcctacttttcag

SEQ ID NO: 2513 - DNA, 16 bp, Artificial sequence
  Synthetic oligonucleotide
ttctaacttctgcacc

SEQ ID NO: 2514 - DNA, 16 bp, Artificial sequence
  Synthetic oligonucleotide
actatatttaaggcct

SEQ ID NO: 2515 - DNA, 16 bp, Artificial sequence
  Synthetic oligonucleotide
agcacctgggtcagct

SEQ ID NO: 2516 - DNA, 16 bp, Artificial sequence
  Synthetic oligonucleotide
cttcaccacgaactgc

SEQ ID NO: 2517 - DNA, 16 bp, Artificial sequence
  Synthetic oligonucleotide
caccaaattgcactcg

SEQ ID NO: 2518 - DNA, 16 bp, Artificial sequence
  Synthetic oligonucleotide
ctaggatcctctacgc

SEQ ID NO: 2519 - DNA, 16 bp, Artificial sequence
  Synthetic oligonucleotide
ttgccgacctcacgga

SEQ ID NO: 2520 - DNA, 16 bp, Artificial sequence
  Synthetic oligonucleotide
tacacctcagtacgaa

SEQ ID NO: 2521 - DNA, 16 bp, Artificial sequence
  Synthetic oligonucleotide
gattcatgagtataag

SEQ ID NO: 2522 - DNA, 16 bp, Artificial sequence
  Synthetic oligonucleotide
tacaaactgcttacag

SEQ ID NO: 2523 - DNA, 16 bp, Artificial sequence
  Synthetic oligonucleotide
cctcagttacacatcc

SEQ ID NO: 2524 - DNA, 16 bp, Artificial sequence
  Synthetic oligonucleotide
tgcctttaggattcta

SEQ ID NO: 2525 - DNA, 16 bp, Artificial sequence
  Synthetic oligonucleotide
ttccacagacctcaac

SEQ ID NO: 2526 - DNA, 16 bp, Artificial sequence
  Synthetic oligonucleotide
actatagcatctgtgg

SEQ ID NO: 2527 - DNA, 16 bp, Artificial sequence
  Synthetic oligonucleotide
gtccctgaaggtgttc

SEQ ID NO: 2528 - DNA, 16 bp, Artificial sequence
  Synthetic oligonucleotide
tcaacatttggcctac

SEQ ID NO: 2529 - DNA, 16 bp, Artificial sequence
  Synthetic oligonucleotide
attacctaaacccacc

SEQ ID NO: 2530 - DNA, 16 bp, Artificial sequence
  Synthetic oligonucleotide
aaatcattgggagtta

SEQ ID NO: 2531 - DNA, 16 bp, Artificial sequence
  Synthetic oligonucleotide
agtatcaaattatgac

SEQ ID NO: 2532 - DNA, 16 bp, Artificial sequence
  Synthetic oligonucleotide
ttcccataattgtagt

SEQ ID NO: 2533 - DNA, 16 bp, Artificial sequence
  Synthetic oligonucleotide
tcttacttgataatac

SEQ ID NO: 2534 - DNA, 16 bp, Artificial sequence
  Synthetic oligonucleotide
ctaagagacattcaag

SEQ ID NO: 2535 - DNA, 16 bp, Artificial sequence
  Synthetic oligonucleotide
ttcaccaaggagctgt

SEQ ID NO: 2536 - DNA, 16 bp, Artificial sequence
  Synthetic oligonucleotide
tctcagggttatgctt

SEQ ID NO: 2537 - DNA, 16 bp, Artificial sequence
  Synthetic oligonucleotide
aatggtagattccgta

SEQ ID NO: 2538 - DNA, 16 bp, Artificial sequence
  Synthetic oligonucleotide
gattaatgtagtgtaa

SEQ ID NO: 2539 - DNA, 16 bp, Artificial sequence
  Synthetic oligonucleotide
aaacgaaacattggca

SEQ ID NO: 2540 - DNA, 16 bp, Artificial sequence
  Synthetic oligonucleotide
atctgttaacagctgc

SEQ ID NO: 2541 - DNA, 16 bp, Artificial sequence
  Synthetic oligonucleotide
aaataagcacttatcc

SEQ ID NO: 2542 - DNA, 16 bp, Artificial sequence
  Synthetic oligonucleotide
acaagtcctacaattt

SEQ ID NO: 2543 - DNA, 16 bp, Artificial sequence
  Synthetic oligonucleotide
catcaaggcactgatc

SEQ ID NO: 2544 - DNA, 16 bp, Artificial sequence
  Synthetic oligonucleotide
agcagtaacatctgat

SEQ ID NO: 2545 - DNA, 16 bp, Artificial sequence
  Synthetic oligonucleotide
gttcgcagacaaagtt

SEQ ID NO: 2546 - DNA, 16 bp, Artificial sequence
  Synthetic oligonucleotide
tctattgccatgtgcc

SEQ ID NO: 2547 - DNA, 16 bp, Artificial sequence
  Synthetic oligonucleotide
taccttttactctgat

SEQ ID NO: 2548 - DNA, 16 bp, Artificial sequence
  Synthetic oligonucleotide
accactctaagattgt

SEQ ID NO: 2549 - DNA, 16 bp, Artificial sequence
  Synthetic oligonucleotide
atcctgaatggcttca

SEQ ID NO: 2550 - DNA, 16 bp, Artificial sequence
  Synthetic oligonucleotide
aattttgagtatgctg

SEQ ID NO: 2551 - DNA, 16 bp, Artificial sequence
  Synthetic oligonucleotide
gcagcgggatcagaac

SEQ ID NO: 2552 - DNA, 16 bp, Artificial sequence
  Synthetic oligonucleotide
tatcactcagctggat

SEQ ID NO: 2553 - DNA, 16 bp, Artificial sequence
  Synthetic oligonucleotide
aagactaaaggcttca

SEQ ID NO: 2554 - DNA, 16 bp, Artificial sequence
  Synthetic oligonucleotide
taaagtaaataggcta

SEQ ID NO: 2555 - DNA, 16 bp, Artificial sequence
  Synthetic oligonucleotide
aaaagcttgttcacct

SEQ ID NO: 2556 - DNA, 16 bp, Artificial sequence
  Synthetic oligonucleotide
ttgctcacatgccagt

SEQ ID NO: 2557 - DNA, 16 bp, Artificial sequence
  Synthetic oligonucleotide
ccttaggataatagcg

SEQ ID NO: 2558 - DNA, 16 bp, Artificial sequence
  Synthetic oligonucleotide
aagcattccttcggat

SEQ ID NO: 2559 - DNA, 16 bp, Artificial sequence
  Synthetic oligonucleotide
aagtggttgcccgctt

SEQ ID NO: 2560 - DNA, 16 bp, Artificial sequence
  Synthetic oligonucleotide
agctactggctgcatc

SEQ ID NO: 2561 - DNA, 16 bp, Artificial sequence
  Synthetic oligonucleotide
cgttaccttgaaaccg

SEQ ID NO: 2562 - DNA, 16 bp, Artificial sequence
  Synthetic oligonucleotide
atacccttctgttaac

SEQ ID NO: 2563 - DNA, 16 bp, Artificial sequence
  Synthetic oligonucleotide
ccacttactggtttaa

SEQ ID NO: 2564 - DNA, 16 bp, Artificial sequence
  Synthetic oligonucleotide
cacccaaaagccctct

SEQ ID NO: 2565 - DNA, 16 bp, Artificial sequence
  Synthetic oligonucleotide
gaagagcattggagat

SEQ ID NO: 2566 - DNA, 16 bp, Artificial sequence
  Synthetic oligonucleotide
ccgcagggatttgaac

SEQ ID NO: 2567 - DNA, 16 bp, Artificial sequence
  Synthetic oligonucleotide
aggatgtatatagttc

SEQ ID NO: 2568 - DNA, 16 bp, Artificial sequence
  Synthetic oligonucleotide
caggctattacctgaa

SEQ ID NO: 2569 - DNA, 16 bp, Artificial sequence
  Synthetic oligonucleotide
accttccgccgcctct

SEQ ID NO: 2570 - DNA, 16 bp, Artificial sequence
  Synthetic oligonucleotide
attcaccaaggagctg

SEQ ID NO: 2571 - DNA, 16 bp, Artificial sequence
  Synthetic oligonucleotide
gccgcagggatttgaa

SEQ ID NO: 2572 - DNA, 16 bp, Artificial sequence
  Synthetic oligonucleotide
gacctgccttcaggcg

SEQ ID NO: 2573 - DNA, 16 bp, Artificial sequence
  Synthetic oligonucleotide
gttttatctaaatacc

SEQ ID NO: 2574 - DNA, 16 bp, Artificial sequence
  Synthetic oligonucleotide
ctggttaggtatgagc

SEQ ID NO: 2575 - DNA, 16 bp, Artificial sequence
  Synthetic oligonucleotide
accaactaagcgaatg

SEQ ID NO: 2576 - DNA, 16 bp, Artificial sequence
  Synthetic oligonucleotide
aggcaaatcgccatgg

SEQ ID NO: 2577 - DNA, 16 bp, Artificial sequence
  Synthetic oligonucleotide
ccccccacggcccgca

SEQ ID NO: 2578 - DNA, 16 bp, Artificial sequence
  Synthetic oligonucleotide
gtgaaaacccactctt

SEQ ID NO: 2579 - DNA, 16 bp, Artificial sequence
  Synthetic oligonucleotide
cccaactgcttgcagt

SEQ ID NO: 2580 - DNA, 16 bp, Artificial sequence
  Synthetic oligonucleotide
tacgcaactgagcccc

SEQ ID NO: 2581 - DNA, 16 bp, Artificial sequence
  Synthetic oligonucleotide
taggtatagtttacca

SEQ ID NO: 2582 - DNA, 16 bp, Artificial sequence
  Synthetic oligonucleotide
aacgggtcatcaaaca

SEQ ID NO: 2583 - DNA, 16 bp, Artificial sequence
  Synthetic oligonucleotide
cagcttatggaacttg

SEQ ID NO: 2584 - DNA, 16 bp, Artificial sequence
  Synthetic oligonucleotide
gaattcgatcaccttc

SEQ ID NO: 2585 - DNA, 16 bp, Artificial sequence
  Synthetic oligonucleotide
ccgcacagctcgggcg

SEQ ID NO: 2586 - DNA, 16 bp, Artificial sequence
  Synthetic oligonucleotide
aaaaacttatctgcgg

SEQ ID NO: 2587 - DNA, 16 bp, Artificial sequence
  Synthetic oligonucleotide
ctccgtcatgttttag

SEQ ID NO: 2588 - DNA, 16 bp, Artificial sequence
  Synthetic oligonucleotide
gatcgccttcaaatta

SEQ ID NO: 2589 - DNA, 16 bp, Artificial sequence
  Synthetic oligonucleotide
ttaaatgacgcaattc

SEQ ID NO: 2590 - DNA, 16 bp, Artificial sequence
  Synthetic oligonucleotide
gtttcctagcttgtct

SEQ ID NO: 2591 - DNA, 16 bp, Artificial sequence
  Synthetic oligonucleotide
accttctaacttctgc

SEQ ID NO: 2592 - DNA, 16 bp, Artificial sequence
  Synthetic oligonucleotide
tactatatttaaggcc

SEQ ID NO: 2593 - DNA, 16 bp, Artificial sequence
  Synthetic oligonucleotide
ggtaattactcttgat

SEQ ID NO: 2594 - DNA, 16 bp, Artificial sequence
  Synthetic oligonucleotide
gtgtagcacctgggtc

SEQ ID NO: 2595 - DNA, 16 bp, Artificial sequence
  Synthetic oligonucleotide
atcttcaccacgaact

SEQ ID NO: 2596 - DNA, 16 bp, Artificial sequence
  Synthetic oligonucleotide
tcaccaaattgcactc

SEQ ID NO: 2597 - DNA, 16 bp, Artificial sequence
  Synthetic oligonucleotide
tctaggatcctctacg

SEQ ID NO: 2598 - DNA, 16 bp, Artificial sequence
  Synthetic oligonucleotide
atattgccgacctcac

SEQ ID NO: 2599 - DNA, 16 bp, Artificial sequence
  Synthetic oligonucleotide
ttacacctcagtacga

SEQ ID NO: 2600 - DNA, 16 bp, Artificial sequence
  Synthetic oligonucleotide
caagattcatgagtat

SEQ ID NO: 2601 - DNA, 16 bp, Artificial sequence
  Synthetic oligonucleotide
atacaaactgcttaca

SEQ ID NO: 2602 - DNA, 16 bp, Artificial sequence
  Synthetic oligonucleotide
cccgcctcagttacac

SEQ ID NO: 2603 - DNA, 16 bp, Artificial sequence
  Synthetic oligonucleotide
gagtcatttgccttta

SEQ ID NO: 2604 - DNA, 16 bp, Artificial sequence
  Synthetic oligonucleotide
ggacatctcttccaca

SEQ ID NO: 2605 - DNA, 16 bp, Artificial sequence
  Synthetic oligonucleotide
tactatagcatctgtg

SEQ ID NO: 2606 - DNA, 16 bp, Artificial sequence
  Synthetic oligonucleotide
agtccctgaaggtgtt

SEQ ID NO: 2607 - DNA, 16 bp, Artificial sequence
  Synthetic oligonucleotide
cttcaacatttggcct

SEQ ID NO: 2608 - DNA, 16 bp, Artificial sequence
  Synthetic oligonucleotide
aattacctaaacccac

SEQ ID NO: 2609 - DNA, 16 bp, Artificial sequence
  Synthetic oligonucleotide
taaatcattgggagtt

SEQ ID NO: 2610 - DNA, 16 bp, Artificial sequence
  Synthetic oligonucleotide
ctctatactttgaagg

SEQ ID NO: 2611 - DNA, 16 bp, Artificial sequence
  Synthetic oligonucleotide
gcatttcccataattg

SEQ ID NO: 2612 - DNA, 16 bp, Artificial sequence
  Synthetic oligonucleotide
gaatcttacttgataa

SEQ ID NO: 2613 - DNA, 16 bp, Artificial sequence
  Synthetic oligonucleotide
ctctaagagacattca

SEQ ID NO: 2614 - DNA, 16 bp, Artificial sequence
  Synthetic oligonucleotide
gaatctcagggttatg

SEQ ID NO: 2615 - DNA, 16 bp, Artificial sequence
  Synthetic oligonucleotide
aaatggtagattccgt

SEQ ID NO: 2616 - DNA, 16 bp, Artificial sequence
  Synthetic oligonucleotide
ggattaatgtagtgta

SEQ ID NO: 2617 - DNA, 16 bp, Artificial sequence
  Synthetic oligonucleotide
caaacgaaacattggc

SEQ ID NO: 2618 - DNA, 16 bp, Artificial sequence
  Synthetic oligonucleotide
tatctgttaacagctg

SEQ ID NO: 2619 - DNA, 16 bp, Artificial sequence
  Synthetic oligonucleotide
aactccacagctctta

SEQ ID NO: 2620 - DNA, 16 bp, Artificial sequence
  Synthetic oligonucleotide
gaacaagtcctacaat

SEQ ID NO: 2621 - DNA, 16 bp, Artificial sequence
  Synthetic oligonucleotide
gcatcaaggcactgat

SEQ ID NO: 2622 - DNA, 16 bp, Artificial sequence
  Synthetic oligonucleotide
tagcagtaacatctga

SEQ ID NO: 2623 - DNA, 16 bp, Artificial sequence
  Synthetic oligonucleotide
gtgttcgcagacaaag

SEQ ID NO: 2624 - DNA, 16 bp, Artificial sequence
  Synthetic oligonucleotide
ctctattgccatgtgc

SEQ ID NO: 2625 - DNA, 16 bp, Artificial sequence
  Synthetic oligonucleotide
acccctgactttctgg

SEQ ID NO: 2626 - DNA, 16 bp, Artificial sequence
  Synthetic oligonucleotide
taccactctaagattg

SEQ ID NO: 2627 - DNA, 16 bp, Artificial sequence
  Synthetic oligonucleotide
caaaatcctgaatggc

SEQ ID NO: 2628 - DNA, 16 bp, Artificial sequence
  Synthetic oligonucleotide
gtaagccccaccccct

SEQ ID NO: 2629 - DNA, 16 bp, Artificial sequence
  Synthetic oligonucleotide
agcagcgggatcagaa

SEQ ID NO: 2630 - DNA, 16 bp, Artificial sequence
  Synthetic oligonucleotide
tttatcactcagctgg

SEQ ID NO: 2631 - DNA, 16 bp, Artificial sequence
  Synthetic oligonucleotide
ttaaggttgcatctgg

SEQ ID NO: 2632 - DNA, 16 bp, Artificial sequence
  Synthetic oligonucleotide
tagtggttcccaatcc

SEQ ID NO: 2633 - DNA, 16 bp, Artificial sequence
  Synthetic oligonucleotide
gaaaaagcttgttcac

SEQ ID NO: 2634 - DNA, 16 bp, Artificial sequence
  Synthetic oligonucleotide
agtttgctcacatgcc

SEQ ID NO: 2635 - DNA, 16 bp, Artificial sequence
  Synthetic oligonucleotide
accttaggataatagc

SEQ ID NO: 2636 - DNA, 16 bp, Artificial sequence
  Synthetic oligonucleotide
caagcattccttcgga

SEQ ID NO: 2637 - DNA, 16 bp, Artificial sequence
  Synthetic oligonucleotide
aaagtggttgcccgct

SEQ ID NO: 2638 - DNA, 16 bp, Artificial sequence
  Synthetic oligonucleotide
ccaagctactggctgc

SEQ ID NO: 2639 - DNA, 16 bp, Artificial sequence
  Synthetic oligonucleotide
gacctcgacaccatcg

SEQ ID NO: 2640 - DNA, 16 bp, Artificial sequence
  Synthetic oligonucleotide
aatacccttctgttaa

SEQ ID NO: 2641 - DNA, 16 bp, Artificial sequence
  Synthetic oligonucleotide
ttacagttcttgaaca

SEQ ID NO: 2642 - DNA, 16 bp, Artificial sequence
  Synthetic oligonucleotide
attcccacccaaaagc

SEQ ID NO: 2643 - DNA, 16 bp, Artificial sequence
  Synthetic oligonucleotide
ctgaagagcattggag

SEQ ID NO: 2644 - DNA, 16 bp, Artificial sequence
  Synthetic oligonucleotide
aaggatgtatatagtt

SEQ ID NO: 2645 - DNA, 16 bp, Artificial sequence
  Synthetic oligonucleotide
gcaggctattacctga

SEQ ID NO: 2646 - DNA, 16 bp, Artificial sequence
  Synthetic oligonucleotide
caccttccgccgcctc

SEQ ID NO: 2647 - DNA, 16 bp, Artificial sequence
  Synthetic oligonucleotide
  misc_feature (5)..(5): bases at these positions are RNA
gaagugtactatccca

SEQ ID NO: 2648 - DNA, 16 bp, Artificial sequence
  Synthetic oligonucleotide
  misc_feature (5)..(5): bases at these positions are RNA
ttttugtggttatagc

SEQ ID NO: 2649 - DNA, 16 bp, Artificial sequence
  Synthetic oligonucleotide
  misc_feature (5)..(5): bases at these positions are RNA
aaaauggtagattccg

SEQ ID NO: 2650 - DNA, 16 bp, Artificial sequence
  Synthetic oligonucleotide
  misc_feature (5)..(5): bases at these positions are RNA
gtggutatagcttgac

SEQ ID NO: 2651 - DNA, 16 bp, Artificial sequence
  Synthetic oligonucleotide
  misc_feature (5)..(5): bases at these positions are RNA
cggtutaatctctttt

SEQ ID NO: 2652 - DNA, 16 bp, Artificial sequence
  Synthetic oligonucleotide
  misc_feature (5)..(5): bases at these positions are RNA
cgctutgttgtctctc

SEQ ID NO: 2653 - DNA, 16 bp, Artificial sequence
  Synthetic oligonucleotide
  misc_feature (5)..(5): bases at these positions are RNA
ggttuaagttggtttt

SEQ ID NO: 2654 - DNA, 16 bp, Artificial sequence
  Synthetic oligonucleotide
  misc_feature (5)..(5): bases at these positions are RNA
ggttutagtcactgga

SEQ ID NO: 2655 - DNA, 16 bp, Artificial sequence
  Synthetic oligonucleotide
  misc_feature (5)..(5): bases at these positions are RNA
gcttugttgtctctcc

SEQ ID NO: 2656 - DNA, 16 bp, Artificial sequence
  Synthetic oligonucleotide
  misc_feature (5)..(5): bases at these positions are RNA
tcctuagttggcatca

SEQ ID NO: 2657 - DNA, 16 bp, Artificial sequence
  Synthetic oligonucleotide
  misc_feature (5)..(5): bases at these positions are RNA
ctgautttaaggttgc

SEQ ID NO: 2658 - DNA, 16 bp, Artificial sequence
  Synthetic oligonucleotide
  misc_feature (5)..(5): bases at these positions are RNA
tgatuttaaggttgca

SEQ ID NO: 2659 - DNA, 16 bp, Artificial sequence
  Synthetic oligonucleotide
  misc_feature (5)..(5): bases at these positions are RNA
agccutcagagattca

SEQ ID NO: 2660 - DNA, 16 bp, Artificial sequence
  Synthetic oligonucleotide
  misc_feature (5)..(5): bases at these positions are RNA
aggautaatgtagtgt

SEQ ID NO: 2661 - DNA, 16 bp, Artificial sequence
  Synthetic oligonucleotide
  misc_feature (5)..(5): bases at these positions are RNA
gtaguaagaatctcag

SEQ ID NO: 2662 - DNA, 16 bp, Artificial sequence
  Synthetic oligonucleotide
  misc_feature (5)..(5): bases at these positions are RNA
gtcauggatttcaagg

SEQ ID NO: 2663 - DNA, 16 bp, Artificial sequence
  Synthetic oligonucleotide
  misc_feature (5)..(5): bases at these positions are RNA
tggtuatagcttgaca

SEQ ID NO: 2664 - DNA, 16 bp, Artificial sequence
  Synthetic oligonucleotide
tagacagacctaaggg

SEQ ID NO: 2665 - DNA, 16 bp, Artificial sequence
  Synthetic oligonucleotide
atgctagcttggccaa

SEQ ID NO: 2666 - DNA, 16 bp, Artificial sequence
  Synthetic oligonucleotide
gggccccagtccttta

SEQ ID NO: 2667 - DNA, 16 bp, Artificial sequence
  Synthetic oligonucleotide
cgtcccaaggactctg

SEQ ID NO: 2668 - DNA, 16 bp, Artificial sequence
  Synthetic oligonucleotide
accccaagaccaaact

SEQ ID NO: 2669 - DNA, 16 bp, Artificial sequence
  Synthetic oligonucleotide
aagtgtttacactgct

SEQ ID NO: 2670 - DNA, 16 bp, Artificial sequence
  Synthetic oligonucleotide
atcgccatggaaagcg

SEQ ID NO: 2671 - DNA, 16 bp, Artificial sequence
  Synthetic oligonucleotide
gtggcccactctgatc

SEQ ID NO: 2672 - DNA, 16 bp, Artificial sequence
  Synthetic oligonucleotide
tcggagcagcacgggc

SEQ ID NO: 2673 - DNA, 16 bp, Artificial sequence
  Synthetic oligonucleotide
cagggacggttgagaa

SEQ ID NO: 2674 - DNA, 16 bp, Artificial sequence
  Synthetic oligonucleotide
cttgagggacagtagg

SEQ ID NO: 2675 - DNA, 16 bp, Artificial sequence
  Synthetic oligonucleotide
ttgagctgcaaacttt

SEQ ID NO: 2676 - DNA, 16 bp, Artificial sequence
  Synthetic oligonucleotide
ggttaaaaataggttc

SEQ ID NO: 2677 - DNA, 16 bp, Artificial sequence
  Synthetic oligonucleotide
acagctcgggcgaggc

SEQ ID NO: 2678 - DNA, 16 bp, Artificial sequence
  Synthetic oligonucleotide
acctattgactatatt

SEQ ID NO: 2679 - DNA, 16 bp, Artificial sequence
  Synthetic oligonucleotide
ttggtattaattcggg

SEQ ID NO: 2680 - DNA, 16 bp, Artificial sequence
  Synthetic oligonucleotide
atggatttcaaggtct

SEQ ID NO: 2681 - DNA, 16 bp, Artificial sequence
  Synthetic oligonucleotide
gttttccacttcaaac

SEQ ID NO: 2682 - DNA, 16 bp, Artificial sequence
  Synthetic oligonucleotide
caatacttgtcttagc

SEQ ID NO: 2683 - DNA, 16 bp, Artificial sequence
  Synthetic oligonucleotide
gtgatttttaaccaac

SEQ ID NO: 2684 - DNA, 16 bp, Artificial sequence
  Synthetic oligonucleotide
tagtcctcaggattta

SEQ ID NO: 2685 - DNA, 16 bp, Artificial sequence
  Synthetic oligonucleotide
ctagcttcatcaaaca

SEQ ID NO: 2686 - DNA, 16 bp, Artificial sequence
  Synthetic oligonucleotide
cttcaccaccaaatcg

SEQ ID NO: 2687 - DNA, 16 bp, Artificial sequence
  Synthetic oligonucleotide
gcatgctggtctagga

SEQ ID NO: 2688 - DNA, 16 bp, Artificial sequence
  Synthetic oligonucleotide
accaaccactcgcttt

SEQ ID NO: 2689 - DNA, 16 bp, Artificial sequence
  Synthetic oligonucleotide
cacctcagtacgaaac

SEQ ID NO: 2690 - DNA, 16 bp, Artificial sequence
  Synthetic oligonucleotide
ctcaaaagcttcagac

SEQ ID NO: 2691 - DNA, 16 bp, Artificial sequence
  Synthetic oligonucleotide
tggcagtctgccctca

SEQ ID NO: 2692 - DNA, 16 bp, Artificial sequence
  Synthetic oligonucleotide
gtcatctattcacaaa

SEQ ID NO: 2693 - DNA, 16 bp, Artificial sequence
  Synthetic oligonucleotide
cctttaggattctaga

SEQ ID NO: 2694 - DNA, 16 bp, Artificial sequence
  Synthetic oligonucleotide
tccacagacctcaacg

SEQ ID NO: 2695 - DNA, 16 bp, Artificial sequence
  Synthetic oligonucleotide
aaagtctgattaaggg

SEQ ID NO: 2696 - DNA, 16 bp, Artificial sequence
  Synthetic oligonucleotide
actcttccaaggataa

SEQ ID NO: 2697 - DNA, 16 bp, Artificial sequence
  Synthetic oligonucleotide
gaaccaaagctgcact

SEQ ID NO: 2698 - DNA, 16 bp, Artificial sequence
  Synthetic oligonucleotide
gccaatatttgcccct

SEQ ID NO: 2699 - DNA, 16 bp, Artificial sequence
  Synthetic oligonucleotide
tggaagttgatatttc

SEQ ID NO: 2700 - DNA, 16 bp, Artificial sequence
  Synthetic oligonucleotide
gcttcccaattcaaac

SEQ ID NO: 2701 - DNA, 16 bp, Artificial sequence
  Synthetic oligonucleotide
tctatactttgaagga

SEQ ID NO: 2702 - DNA, 16 bp, Artificial sequence
  Synthetic oligonucleotide
gagaaccacacactac

SEQ ID NO: 2703 - DNA, 16 bp, Artificial sequence
  Synthetic oligonucleotide
aagctaccatcagaag

SEQ ID NO: 2704 - DNA, 16 bp, Artificial sequence
  Synthetic oligonucleotide
atcagttacaatttac

SEQ ID NO: 2705 - DNA, 16 bp, Artificial sequence
  Synthetic oligonucleotide
tcaacaaaagcccacc

SEQ ID NO: 2706 - DNA, 16 bp, Artificial sequence
  Synthetic oligonucleotide
ctcagaagatgttatc

SEQ ID NO: 2707 - DNA, 16 bp, Artificial sequence
  Synthetic oligonucleotide
caattcaccaaggagc

SEQ ID NO: 2708 - DNA, 16 bp, Artificial sequence
  Synthetic oligonucleotide
catatgcagataatgt

SEQ ID NO: 2709 - DNA, 16 bp, Artificial sequence
  Synthetic oligonucleotide
gacattgcctcttcat

SEQ ID NO: 2710 - DNA, 16 bp, Artificial sequence
  Synthetic oligonucleotide
gtagtgtaacattttc

SEQ ID NO: 2711 - DNA, 16 bp, Artificial sequence
  Synthetic oligonucleotide
cgaaacattggcacac

SEQ ID NO: 2712 - DNA, 16 bp, Artificial sequence
  Synthetic oligonucleotide
tctgaggcaaacgaaa

SEQ ID NO: 2713 - DNA, 16 bp, Artificial sequence
  Synthetic oligonucleotide
aagttaaacttatctg

SEQ ID NO: 2714 - DNA, 16 bp, Artificial sequence
  Synthetic oligonucleotide
tatccctaacatgcaa

SEQ ID NO: 2715 - DNA, 16 bp, Artificial sequence
  Synthetic oligonucleotide
cgatggaaaaatttct

SEQ ID NO: 2716 - DNA, 16 bp, Artificial sequence
  Synthetic oligonucleotide
tttagaggcttttaag

SEQ ID NO: 2717 - DNA, 16 bp, Artificial sequence
  Synthetic oligonucleotide
gtaacatctgattcta

SEQ ID NO: 2718 - DNA, 16 bp, Artificial sequence
  Synthetic oligonucleotide
tgccccaacactgaac

SEQ ID NO: 2719 - DNA, 16 bp, Artificial sequence
  Synthetic oligonucleotide
atcctgatctggtcca

SEQ ID NO: 2720 - DNA, 16 bp, Artificial sequence
  Synthetic oligonucleotide
tcctgccttaaagtta

SEQ ID NO: 2721 - DNA, 16 bp, Artificial sequence
  Synthetic oligonucleotide
gtctaagaggttattt

SEQ ID NO: 2722 - DNA, 16 bp, Artificial sequence
  Synthetic oligonucleotide
agcatttaaagttaac

SEQ ID NO: 2723 - DNA, 16 bp, Artificial sequence
  Synthetic oligonucleotide
gatgaaatgcctctgc

SEQ ID NO: 2724 - DNA, 16 bp, Artificial sequence
  Synthetic oligonucleotide
aactcactgcaaggtc

SEQ ID NO: 2725 - DNA, 16 bp, Artificial sequence
  Synthetic oligonucleotide
acctgaagtcaagaca

SEQ ID NO: 2726 - DNA, 16 bp, Artificial sequence
  Synthetic oligonucleotide
tcactcagctggattt

SEQ ID NO: 2727 - DNA, 16 bp, Artificial sequence
  Synthetic oligonucleotide
caaatacgactgctta

SEQ ID NO: 2728 - DNA, 16 bp, Artificial sequence
  Synthetic oligonucleotide
tgttcctgcatgtaag

SEQ ID NO: 2729 - DNA, 16 bp, Artificial sequence
  Synthetic oligonucleotide
gtggttcccaatcccc

SEQ ID NO: 2730 - DNA, 16 bp, Artificial sequence
  Synthetic oligonucleotide
cacatgccagttactc

SEQ ID NO: 2731 - DNA, 16 bp, Artificial sequence
  Synthetic oligonucleotide
gtgcctttagtgaggg

SEQ ID NO: 2732 - DNA, 16 bp, Artificial sequence
  Synthetic oligonucleotide
gtacttcaagcattcc

SEQ ID NO: 2733 - DNA, 16 bp, Artificial sequence
  Synthetic oligonucleotide
agtggttgcccgcttt

SEQ ID NO: 2734 - DNA, 16 bp, Artificial sequence
  Synthetic oligonucleotide
gcaaattaatggcctt

SEQ ID NO: 2735 - DNA, 16 bp, Artificial sequence
  Synthetic oligonucleotide
attacagttcttgaac

SEQ ID NO: 2736 - DNA, 16 bp, Artificial sequence
  Synthetic oligonucleotide
tgccaaccaccagcat

SEQ ID NO: 2737 - DNA, 16 bp, Artificial sequence
  Synthetic oligonucleotide
gtcaaagcaaagacgc

SEQ ID NO: 2738 - DNA, 16 bp, Artificial sequence
  Synthetic oligonucleotide
cgtgtaaatatgaata

SEQ ID NO: 2739 - DNA, 16 bp, Artificial sequence
  Synthetic oligonucleotide
aggctggttatgactc

SEQ ID NO: 2740 - DNA, 16 bp, Artificial sequence
  Synthetic oligonucleotide
gttgctaaaatggcgc

SEQ ID NO: 2741 - DNA, 16 bp, Artificial sequence
  Synthetic oligonucleotide
tggaatggccagccta

SEQ ID NO: 2742 - DNA, 16 bp, Artificial sequence
  Synthetic oligonucleotide
atgagcttcagacctt

SEQ ID NO: 2743 - DNA, 16 bp, Artificial sequence
  Synthetic oligonucleotide
cgaatggctttgtctc

SEQ ID NO: 2744 - DNA, 16 bp, Artificial sequence
  Synthetic oligonucleotide
gaaatttttctaccgt

SEQ ID NO: 2745 - DNA, 16 bp, Artificial sequence
  Synthetic oligonucleotide
cactcttggaaaacgc

SEQ ID NO: 2746 - DNA, 16 bp, Artificial sequence
  Synthetic oligonucleotide
cagtcctgcgacttgc

SEQ ID NO: 2747 - DNA, 16 bp, Artificial sequence
  Synthetic oligonucleotide
gtgatagttcagggct

SEQ ID NO: 2748 - DNA, 16 bp, Artificial sequence
  Synthetic oligonucleotide
ggtcatcaaacacctc

SEQ ID NO: 2749 - DNA, 16 bp, Artificial sequence
  Synthetic oligonucleotide
ggaacttgaatgcaaa

SEQ ID NO: 2750 - DNA, 16 bp, Artificial sequence
  Synthetic oligonucleotide
tccgccgcctttgtga

SEQ ID NO: 2751 - DNA, 16 bp, Artificial sequence
  Synthetic oligonucleotide
cggtttcctcaagctc

SEQ ID NO: 2752 - DNA, 16 bp, Artificial sequence
  Synthetic oligonucleotide
cgtcatgttttagaaa

SEQ ID NO: 2753 - DNA, 16 bp, Artificial sequence
  Synthetic oligonucleotide
cgccttcaaattattt

SEQ ID NO: 2754 - DNA, 16 bp, Artificial sequence
  Synthetic oligonucleotide
aattgtttcatcctac

SEQ ID NO: 2755 - DNA, 16 bp, Artificial sequence
  Synthetic oligonucleotide
acattttgcccttagc

SEQ ID NO: 2756 - DNA, 16 bp, Artificial sequence
  Synthetic oligonucleotide
gtgctattttatccaa

SEQ ID NO: 2757 - DNA, 16 bp, Artificial sequence
  Synthetic oligonucleotide
gtaaacaccctcatct

SEQ ID NO: 2758 - DNA, 16 bp, Artificial sequence
  Synthetic oligonucleotide
taaggccttccaaatt

SEQ ID NO: 2759 - DNA, 16 bp, Artificial sequence
  Synthetic oligonucleotide
tcactgaatccacttc

SEQ ID NO: 2760 - DNA, 16 bp, Artificial sequence
  Synthetic oligonucleotide
caaatcgcactggctc

SEQ ID NO: 2761 - DNA, 16 bp, Artificial sequence
  Synthetic oligonucleotide
gctaccttcatcacca

SEQ ID NO: 2762 - DNA, 16 bp, Artificial sequence
  Synthetic oligonucleotide
acactggcatgctggt

SEQ ID NO: 2763 - DNA, 16 bp, Artificial sequence
  Synthetic oligonucleotide
aaacctacaacacccg

SEQ ID NO: 2764 - DNA, 16 bp, Artificial sequence
  Synthetic oligonucleotide
gtctgccctcaaaagc

SEQ ID NO: 2765 - DNA, 16 bp, Artificial sequence
  Synthetic oligonucleotide
gttttcctcaaattcg

SEQ ID NO: 2766 - DNA, 16 bp, Artificial sequence
  Synthetic oligonucleotide
agttacacatccaaac

SEQ ID NO: 2767 - DNA, 16 bp, Artificial sequence
  Synthetic oligonucleotide
gattctagacagacct

SEQ ID NO: 2768 - DNA, 16 bp, Artificial sequence
  Synthetic oligonucleotide
atcctgatattggatt

SEQ ID NO: 2769 - DNA, 16 bp, Artificial sequence
  Synthetic oligonucleotide
aactaccagccatttc

SEQ ID NO: 2770 - DNA, 16 bp, Artificial sequence
  Synthetic oligonucleotide
atcccaaaatgcttca

SEQ ID NO: 2771 - DNA, 16 bp, Artificial sequence
  Synthetic oligonucleotide
cagtccctgaaggtgt

SEQ ID NO: 2772 - DNA, 16 bp, Artificial sequence
  Synthetic oligonucleotide
acttttcagcttcaac

SEQ ID NO: 2773 - DNA, 16 bp, Artificial sequence
  Synthetic oligonucleotide
tttggcctactcaagc

SEQ ID NO: 2774 - DNA, 16 bp, Artificial sequence
  Synthetic oligonucleotide
gagttacttgccaact

SEQ ID NO: 2775 - DNA, 16 bp, Artificial sequence
  Synthetic oligonucleotide
gcccaaattaatgcac

SEQ ID NO: 2776 - DNA, 16 bp, Artificial sequence
  Synthetic oligonucleotide
cccagtaggccagacc

SEQ ID NO: 2777 - DNA, 16 bp, Artificial sequence
  Synthetic oligonucleotide
cagtttctatagtagt

SEQ ID NO: 2778 - DNA, 16 bp, Artificial sequence
  Synthetic oligonucleotide
gcagttaaacaatgga

SEQ ID NO: 2779 - DNA, 16 bp, Artificial sequence
  Synthetic oligonucleotide
aaaagcccaccctcta

SEQ ID NO: 2780 - DNA, 16 bp, Artificial sequence
  Synthetic oligonucleotide
cctcatcaacaaaagc

SEQ ID NO: 2781 - DNA, 16 bp, Artificial sequence
  Synthetic oligonucleotide
cttattccccaatgga

SEQ ID NO: 2782 - DNA, 16 bp, Artificial sequence
  Synthetic oligonucleotide
tggtagattccgtaac

SEQ ID NO: 2783 - DNA, 16 bp, Artificial sequence
  Synthetic oligonucleotide
gcttttgtaaaagcag

SEQ ID NO: 2784 - DNA, 16 bp, Artificial sequence
  Synthetic oligonucleotide
gatcccaactcatctc

SEQ ID NO: 2785 - DNA, 16 bp, Artificial sequence
  Synthetic oligonucleotide
gcaaacgaaacattgg

SEQ ID NO: 2786 - DNA, 16 bp, Artificial sequence
  Synthetic oligonucleotide
aatgaagcaactcttc

SEQ ID NO: 2787 - DNA, 16 bp, Artificial sequence
  Synthetic oligonucleotide
aacatgcaatactgca

SEQ ID NO: 2788 - DNA, 16 bp, Artificial sequence
  Synthetic oligonucleotide
ccatggttgatattta

SEQ ID NO: 2789 - DNA, 16 bp, Artificial sequence
  Synthetic oligonucleotide
ctatcccatcactgaa

SEQ ID NO: 2790 - DNA, 16 bp, Artificial sequence
  Synthetic oligonucleotide
agattcaatgctaaac

SEQ ID NO: 2791 - DNA, 16 bp, Artificial sequence
  Synthetic oligonucleotide
gtatacattctctaat

SEQ ID NO: 2792 - DNA, 16 bp, Artificial sequence
  Synthetic oligonucleotide
tgttcgcagacaaagt

SEQ ID NO: 2793 - DNA, 16 bp, Artificial sequence
  Synthetic oligonucleotide
cttaaagttacattcg

SEQ ID NO: 2794 - DNA, 16 bp, Artificial sequence
  Synthetic oligonucleotide
gaattattatatgctc

SEQ ID NO: 2795 - DNA, 16 bp, Artificial sequence
  Synthetic oligonucleotide
tagacccctgactttc

SEQ ID NO: 2796 - DNA, 16 bp, Artificial sequence
  Synthetic oligonucleotide
cctatataaggtcaat

SEQ ID NO: 2797 - DNA, 16 bp, Artificial sequence
  Synthetic oligonucleotide
atacactcactagaac

SEQ ID NO: 2798 - DNA, 16 bp, Artificial sequence
  Synthetic oligonucleotide
acaagtaagccccacc

SEQ ID NO: 2799 - DNA, 16 bp, Artificial sequence
  Synthetic oligonucleotide
ggatcagaacagtact

SEQ ID NO: 2800 - DNA, 16 bp, Artificial sequence
  Synthetic oligonucleotide
tcacaatgcattctaa

SEQ ID NO: 2801 - DNA, 16 bp, Artificial sequence
  Synthetic oligonucleotide
tttcctcaacactcag

SEQ ID NO: 2802 - DNA, 16 bp, Artificial sequence
  Synthetic oligonucleotide
aaagactaaaggcttc

SEQ ID NO: 2803 - DNA, 16 bp, Artificial sequence
  Synthetic oligonucleotide
ttaaagtaaataggct

SEQ ID NO: 2804 - DNA, 16 bp, Artificial sequence
  Synthetic oligonucleotide
ttttgtccactggtga

SEQ ID NO: 2805 - DNA, 16 bp, Artificial sequence
  Synthetic oligonucleotide
cttaggataatagcgc

SEQ ID NO: 2806 - DNA, 16 bp, Artificial sequence
  Synthetic oligonucleotide
taagagctgctataaa

SEQ ID NO: 2807 - DNA, 16 bp, Artificial sequence
  Synthetic oligonucleotide
ctgcatcgaggtgagg

SEQ ID NO: 2808 - DNA, 16 bp, Artificial sequence
  Synthetic oligonucleotide
aatagagctacttagc

SEQ ID NO: 2809 - DNA, 16 bp, Artificial sequence
  Synthetic oligonucleotide
gaaaaagtcttagcag

SEQ ID NO: 2810 - DNA, 16 bp, Artificial sequence
  Synthetic oligonucleotide
accttcatgaccctac

SEQ ID NO: 2811 - DNA, 16 bp, Artificial sequence
  Synthetic oligonucleotide
aaccccgtcctggaaa

SEQ ID NO: 2812 - DNA, 16 bp, Artificial sequence
  Synthetic oligonucleotide
tagttcaaagatattg

SEQ ID NO: 2813 - DNA, 16 bp, Artificial sequence
  Synthetic oligonucleotide
gtagggcttctcaaaa

SEQ ID NO: 2814 - DNA, 21 bp, Artificial sequence
  Primer
aaagcaaggtctccccacaag

SEQ ID NO: 2815 - DNA, 24 bp, Artificial sequence
  Primer
tgaagggtctgtgctagatcaaaa

SEQ ID NO: 2816 - DNA, 19 bp, Artificial sequence
  Probe
tgccacatcgccaccccgt

SEQ ID NO: 2817 - DNA, 25 bp, Artificial sequence
  Primer
cggactatgacttagttgcgttaca

SEQ ID NO: 2818 - DNA, 21 bp, Artificial sequence
  Primer
gccatgccaatctcatcttgt

SEQ ID NO: 2819 - DNA, 30 bp, Artificial sequence
  Probe
cctttcttgacaaaacctaacttgcgcaga

SEQ ID NO: 2820 - DNA, 25 bp, Artificial sequence
  Primer
gaattgcgtcatttaaagcctagtt

SEQ ID NO: 2821 - DNA, 25 bp, Artificial sequence
  Primer
tcatcctaccactcccaattaatct

SEQ ID NO: 2822 - DNA, 30 bp, Artificial sequence
  Probe
acgcatttactaaacgcagacgaaaatgga

SEQ ID NO: 2823 - DNA, 13000 bp, Mus musculus
actgcacagtgagacccttctatacaaagtaaaagacagttaggcatgcagctcagaggtaggttgtctacctagcaagcttgaggtcttgagttcaatcttttttttttttttttttttttttggttttctgagacagggtttctctgtgtagccctggctgtcctggaactcactctgtagaccaggctggcctcgaactcagaaatccgcctgcctctgcctcccgagtgctgggattaaaggcgtgcgccaccacgcctggccgagttcaatcttttaactttggaaaagacccacgaaacaaaagaggatgagaatcagagtggtttggaaattaccaaagcctgtttgtgaagtaaaataaaagttaagaagggggaagacagtgggcatttgggccctagcaataagaaaaggtaatccagaatgttctctagaaatattcccgtggcgttcactgggaactcccttgctgccttcataaaccatgtcttttggtagtttctggagtgaccctgctgcctgtttctctctccaaaccctgggagttgcccagtgccgcacagccattccaaaagcaaggaaaagtttgtatgatgtgtgaaggaatcaagaagatggacttacagacaagcactttagggggcgagggaaggaagggggaaaggcttgcctagtttcccttatctgcagggtttctaaaacaacaacaacaacaacaacaaaacaaatctccatagtttatgccagaagtgagccccgcctttaatcccagcactcagaaggtagatcctgacagatctgagtttccaggccagccagggatacagttttaggacaatatggcagtgagactctgtctcaaaacatgtcaccctatacactttatcattttttttaattccagacagggtttctctgtgtatctctggctgtcctggaactcactctgtagaccaggctggccttgaactcagaaatctgcctgcccctgcctcccaagtgtgccaccactgcctggtgactttatttttattttattttttaaagaaacaacaacaaagcgtggggtctcctatctgtcttggctcacctggaaccctctatgtagaacagccggccccgaacttgcagagatccagccctaccattttaaagattggtttcatttccctggcctccagaacggtcttagaccctccccccagcagaagcaaagcagaaacagaaggtcgggggaggagagggaggtgggtaggttaagaggaacgatgaagaacaccttctgctagttaactttgcctaattatagatgaatcacagatgcccgacactcagatcaccgcccataatttaggtgactcaagtttttgtcctttcagaactaaaattctaaaaaatttccaggcccaaagcatccatcaagtgtgcctctagagaggaaccgtttgcactcagtaacattccattctttagggcttcttacagacagaaaaagagaaaagtagggcagttttgcaagggtcacctgaaagctgcttaaacaagccccaggcttggtacacacagctttaatccagcacttgtgtaaggacctgagtttgaggccagcctggtccagaaaccctgtctcaggaaaaataaataaggaagaaagaaaaagcttaaactggccattgggatgggaagggaggcaatggtctaacactggacctccagctttgctagagccccacctcagtctaagggtgcctctctcctttagttttataatagaatattcatgtaattttatgtccttagtgactatcagcctgtatggtcattaagttctgtctaccctgggaaagcctctgcccaaacctccctattcacaggtcctagaacgtagaggtggggagcaggacggtgccgccaggccgtgtgcgatcgcgagctctggatctcaatgcgccccggggcgctgtttcccacgactccagcagcttttctaaaaatccaggcagcctccagtttacgggatcaacccgagactcgcttccctttgaaaattctagagtataaagtaaacgtacgagcaaagtatgtgtcttaacacttaatggatgacatagagaccaaaaaagccatgtccgtgggcccagtaggccgcaataaggggcgaccaggaaactgcagcacagccccccgcagccgccctgctcccacaccagtcattccagcaccgtggtgaaggcgcttgggggcggggcggggcgcgcctgcgcagcgaggctctgcagcagaaactttgcctagaccggctggaaccggttagaaccggtcgaacccggccggctgccagccctcgattcagcagctcacaaagggaggcggcgactcacgacccgcgtatccttgcgcctctccccaccccctttgtcctcgcgacgggttccgcggtcctccccgccctccctggcgcggcccccgctttctgcgcccagtgacgctttctccatggtcctgggagaaagagaaaaacatcctttcccctccgtcgtagttttaggaagcgatgagatagacctggggaccttgccgccacgggccgggctctgacggttattagcgcagtgcgggtggtgctcggcatggccgccaaggtcgccgtgccctcacctgcagcgaccatggccttgctgggctgagaccgcagcctaacatggcggacgtaggcaagcaccaaagcgctcgtgtacccgggctcggaaaagtggccccgagagcagccggaggctgcaggtcgtccctacaggagcattcccagtataaaccagtacaaagtgtcaccacctcagaagccactcgcagggccggtcactttccgagagacctccatcttgtttcgcatgaaatggcagccgctcggggagttacaaaatgggaagtggaagctgaagctgtgggaaagcctgttttaacacttgcaacatacgctataccctctgtcctcccaggaaaacgcaaaaggtgttgaaacatctgaaaaacttggggctcccatttttaatagctattagttcatgttttttctccttgtgaccagaaattttaaacctatttgtacctatttagctggtacaagctaaacatttctctgtattagcaaggtccaagaggcccacacgacgtcaagaaaaatctagaaacttggaagtcaggatctatttttaactctctgaggaactatttttcttccttcaccaaggtggtggagggttactaggttccggtggagtgacgtgtccctttgcaataaataccggcgctccgggctctgcgtcaggcattcaggcagcgagagcagagcagcgtagagcagcacagctgagctcgtgaggcaggagactcagcccgaggaaatcgcagataagtttttaattaaaaagattgagcagtaaaaagaattagaactctaaacttaagctaatagagtagcttatcgaaatattacttagtcttaataatctaagaagatcttaagagataacatgaaggcttatttaaacagtttgaaaaaggaaatgaggagaaaagtatttgtactgtataatggaggctgaccagagcagtttaggagattgtaaagggaggttttgtgaagttctaaaaggttctagtttgaaggtcggccttgtagattaaaacgaaggttacctaaatagaatctaagtggcatttaaaacagtaaagttgtagagaatagtttgaaaatgaggtgtagttttaaaagattgagaaaagtaggttaagttgacggccgttataaaaatccttcgactggcgcatgtacgtttgaaggcatgagttggaaacagggaagatggaagtgttaggctagccgggcgatggtggcgcacgcctttaatcctagcacttgggaggcagaggcaggcggatttctgagttcgaggccagcctggtctacagagtgagttccaggacagccagggctacacagagaaaccctgtcttgaaaaaacaaaaaggttaggctagtatttggagaaagaagattagaaaatggaagtgaaagacgaagaagacatacaggaaggtgaagaaaaagctgttagagaagataggaaaatagaagacaaagcatctttagaagacagaaaaggtacttaaaggcacaggtagtaggaagccgaagaatagaagatagaaagaagcaagatagaaaaacaaaatggaagttaagacaactttggatgccagcattcaagataggcaaagaagataagattgaggccaaaaggttggataagatataaagtcagaaggaaattatctttaaagccataagttcaaatttctgatggagcgagcagtttagaagagtctttagacagccacatacaagattgaagctagcaatcaaagctactaggactgaagtaaaaagttaaggcagaatgcctttgaagagttagaagaatattaaaagccttaacttgtagcttaattttgcttgatgacaaaaggacttttgataacagtttcaagattgtcagcattttgcattggacttgagctgaggtgcttttaaaatcctaacgactagcattggcagctgacccaggtctacacagaagtgcattcagtgaactaggaagacaggagcggcagacaggagtcccgaagccagtttggtgaagctaggaaggactgaggagccagcagcagcagtgcatggtgaagatagcccaggaaagagtgcggttcggtggaggaagctaggaagaaggagccatacggatgtggtggtgaagctgggaaagggttccaggatggtggagcgagagcgagttggtgatgaagctagctggcggcttggcttgtcaactgcgcggaggaggcgagcaggcattgtggagaggatagatagcggctcctagaccagcatgccagtgtgcaagaaaggctgcagggagagcatgcggtgcggtaacattccttgaggtcggcaacatggtggtggttttctgtaacttggatggtaacttgtttactttgtcttaatagttatgggggagttgtaggcttctgtgtaaagagatatatctggggctgtatgtaggcctttgcgggtgttgtaggtttttctttttcagggttatgtcctcttgcatcttgtcagaagcttttgagggctgactgccaaggcccagaaagaagaatggtagatggcaagttgtctttaaccgctcagaggggaatgaatggtagagccagcacaacctcccagttttgtaagacgttgtagtttgaacagatgacctaccacaagcctcactcctgtgtaggggaggtaattgggcaaagtgcttttgggggaatgggggcaaaatatattttgagttcttttccccttaggtctgtctagaatcctaaaggcagatgactcaagggaaccagaaaaaaggaaatccactctcaggataagcagagctcgccaggtttacagtttgtaggaagtagaggatggatgctagctttcacactgagtgtggaggagctggccatggcggaattgctggtagtttactctttccccctcccttaatgagatttgtaaaatcctaaacacttttacttgaaatatttgggagtggtcttaacagggaggagtgggtgggggaaacgttttttttctaagattttccacagatgctatagttgtgttgacacactgggttagagaaggcgtgtactgctatgctgttggcacgacaccttcagggactggagctgccttttgtccttggaagagttttcccagttgccgctgaagtcagcacagtgcggctttggttcacagtcacctcaggagaacctcaggagcttggctaggccagaggttgaagttaagttttacagcaccgtgatttaaaatatttcattaaaggggaggggtaaaacttagttggctgtggccttgtgtttgggtgggtgggggtgttaggtaattgtttagtttatgatttcagataatcataccagagaacttaaatatttggaaaaacaggaaatctcagctttcaagttggcaagtaactcccaatccagtttttgcttcttttttcctttttctttttttgaggcgggcagctaaggaaggttggttcctctgccggtccctcgaaagcgtagggcttgggggttggtctggtccactgggatgatgtgatgctacagtggggactcttctgaagctgttggatgaatatagattgtagtgtgtggttctcttttgaaatttttttcaggtgacttaatgtatcttaataactactataggaacaaaggaagtggctttaatgaccctgaaggaatttcttctggtgatagcttttatattatcaagtaagagatactatctcagttttgtataagcaagtctttttcctagtgtaggagaaatgattttccttgtgactaaacaagatgtaaaggtatgctttttttcttcttgtgcattgtatacttgtgtttatttgtaacttataatttaagaattatgataattcagcctgaatgtcttttagagggtgggcttttgttgatgagggaggggaaacctttttttttctgtagacctttttcagataacaccatctgagtcataaccagcctggcagtgtgatgacgtagatgcagagggagcagctccttggtgaatgagtgataagtaaaggcagaaaaaataatgtcatgtctccatggggaatgagcatgagccagagattgttcctactgatgaaaagctgcatatgcaaaaatttaagcaaatgaaagcaaccagtataaagttatggcaatacctttaaaagttatggcttatctaccaagctttatccacaaaagtaaagaattgatgaaaaacagtgaagatcaaatgttcatctcaaaactgcttttacaaaagcagaatagaaatgaagtgaaaatgctgcattaagcctggagtaaaaagaagctgagcttgttgagatgagtgggatcgagcggctgcgaggcggtgcagtgtgccaatgtttcgtttgcctcagacaggtttctcttcataagcagaagagttgcttcattccatctcggagcaggaaacagcagactgctgttgacagataagtgtaacttggatctgcagtattgcatgttagggatagataagtgccttttttctctttttccaaaaagacctgtagagctgttgaatgtttgcagctggcccctcttaggcagttcagaattttgagtagttttcccatccagcctcttaaaaattcctaagccttgcaccgatgggctttcatgatgggatagctaataggcttttgcatcgtaaacttcaacacaaaagcctacatgattaatgcctactttaattacattgcttacaagattaaggaatctttatcttgaagaccccatgaaagggatcattatgtgctgaaaattagatgttcatattgctaaaatttaaatgtgctccaatgtacttgtgcttaaaatcattaaattatacaaattaataaaatacttcactagagaatgtatgtatttagaaggctgtctccttatttaaataaagtcttgtttgttgtctgtagttagtgtgggcaattttggggggatgttcttctctaatcttttcagaaacttgacttcgaacacttaagtggaccagatcaggatttgagccagaagaccgaaattaactttaaggcaggaaagacaaattttattctccatgcagtgatgagcatttaataattgcaggcctggcatagaggccgtctaactaaggactaagtaccttaggcaggtgggagatgatggtcagagtaaaaggtaactacatattttgtttccagaaagtcaggggtctaatttgaccatggctaaacatctagggtaagacacttttcccccacatttccaaatatgcatgttgagtttaaatgcttacgatcatctcatccactttagccttttgtcacctcacttgagccacgagtggggtcaggcatgtgggtttaaagagttttcctttgcagagcctcatttcatccttcatggagctgctcaggactttgcatataagcgcttgcctctgtcttctgttctgctagtgagtgtgtgatgtgagaccttgcagtgagtttgtttttcctggaatgtggagggagggggggatggggcttacttgttctagctttttttttacagaccacacagaatgcaggtgtcttgacttcaggtcatgtctgttctttggcaagtaatatgtgcagtactgttccaatctgctgctattagaatgcattgtgacgcgactggagtatgattaaagaaagttgtgtttccccaagtgtttggagtagtggttgttggaggaaaagccatgagtaacaggctgagtgttgaggaaatggctctctgcagctttaagtaacccgtgtttgtgattggagccgagtccctttgctgtgctgccttaggtaaatgtttttgttcatttctggtgaggggggttgggagcactgaagcctttagtctcttccagattcaacttaaaatctgacaagaaataaatcagacaagcaacattcttgaagaaattttaactggcaagtggaaatgttttgaacagttccgtggtctttagtgcattatctttgtgtaggtgttctctctcccctcccttggtcttaattcttacatgcaggaacattgacaacagcagacatctatctattcaaggggccagagaatccagacccagtaaggaaaaatagcccatttactttaaatcgataagtgaagcagacatgccattttcagtgtggggattgggaagccctagttctttcagatgtacttcagactgtagaaggagcttccagttgaattgaaattcaccagtggacaaaatgaggacaacaggtgaacgagccttttcttgtttaagattagctactggtaatctagtgttgaatcctctccagcttcatgctggagcagctagcatgtgatgtaatgttggccttggggtggaggggtgaggtgggcgctaagcctttttttaagatttttcaggtacccctcactaaaggcactgaaggcttaatgtaggacagcggagccttcctgtgtggcaagaatcaagcaagcagtattgtatcgagaccaaagtggtatcatggtcggttttgattagcagtggggactaccctaccgtaacaccttgttggaattgaagcatccaaagaaaatacttgagaggccctgggcttgttttaacatctggaaaaaaggctgtttttatagcagcggttaccagcccaaacctcaagttgtgcttgcaggggagggaaaagggggaaagcgggcaaccagtttccccagcttttccagaatcctgttacaaggtctccccacaagtgatttctctgccacatcgccaccatgggcctttggcctaatcacagacccttcacccctcaccttgatgcagccagtagctggatccttgaggtcacgttgcatatcggtttcaaggtaaccatggtgccaaggtcctgtgggttgcaccagaaaaggccatcaattttccccttgcctgtaatttaacattaaaaccatagctaagatgttttatacatagcacctatgcagagtaaacaaaccagtatgggtatagtatgtttgataccagtgctgggtgggaatgtaggaagtcggatgaaaagcaagcctttgtaggaagttgttggggtgggattgcaaaaattctctgctaagactttttcaggtggacataacagacttggccaagctagcatcttagtggaagcagattcgtcagtagggttgtaaaggtttttcttttcctgagaaaacaaccttttgttttctcaggttttgctttttggcctttccctagctttaaaaaaaaaaaagcaaaagacgctggtggctggcactcctggtttccaggacggggttcaagtccctgcggtgtctttgcttgactcttatatcatgaggccattacatttttcttggagggttctaaaggctctgggtatggtagctgatatcactggaacactccccagcctcagtgttgaactcttgataattaactgcattgtctttcaggttatgcccaattcgtcttattacctctgagtcgacacacctcctactatttattgaatactttgattttatgaaataaaaactaaatatctctcattgtgtgcttctttgtgcataaaacacaggcttattttaagcctaaagagaccaaatgtctgatctacctcagcttctccgattagtgaggccttccctgtttccttgggctgcatggctctttcatgcagatggctctaaagttgggcttgggtcctaggtggccactcttgcacctcaggaacacaaggcctttccctgctgttcaggctctcctccctgagaaaacattctggattgtctatgaggaagttgggaaaagatggtgtcgaaaagaggtggtgtgcattgctcctctgttcctaacactggatggaagactagttttcatgtagtttagggaaatagttatacatggtctaaaggcccaaaaacattcccagagtgtatgcaatactgtgtgtaagtgtgcactgcgtgtgtttggaggtcagaacttctctgaggttctagagatgaagcaagtcctcagccatggcccaagaatgggaaggaactgggtcctgctgtaccacttcccattccttaaggaacagtttggcccggtgtggtgcaagcatggtcggtcactgaaaaaagaaaacccacttaggtttcacaggcttgaagagctgcatgtcatccagcaaattactggctgctgtaaggacaggcccctaggtcccagtcccaggtgcccttcctgccactcaatcaagccttacaccctgggcaaaaacatcctgcgttgaaggttcagctcccagggctggaaacttgtgctggcatctaccccagttcaaaggggctcagcacattgacaactaaaactaagccctcaggtgagcaaaatggtctccttaaggcaatcatggtcattggtgttcctgcagtaaaggacagcatcacagctgatgtctgtgtactggctagttttgtatcaacttgacacagctggaattatcacagagaaagcttcagttggggaagtgcctccaagagatcctccacgagatcctgctctaaggcattttctcaattagtgatcaagggggaaagaccccttgtgtgtgggaccatctctgggctggtagtcttggttcagttctataagagagcaggctgagcaagccaggggaagcaagccagtaaagaacatccctccatggcctctgcatcagctcctgcttcctgacctgcttgagttccagtcctgacttccttggtgatgaacagcagtatggaagtgtaagccgaataaaccctgtcctccccaacttgcttcttggtcatgtttgtgcaggaatagaaaccctgactaagacagtctgagacctgacagatctgtgctaaagtctggtaccaactgagctagaccctgccacacacctcagtaatggcccattctgaattcacccagagctgaggctttgccgaggtgaggcacaaagacttcactggagagcaggagatatgaacagaggttggggctcacacttcctgattgggggccaggactgggggcaagatgaaggaacggtaggcatgcttgtaaatttcccaaagggttagatccagatcttagctttcagtgtgtaggccagggtgactctgaatttgggtccttggacctcaactttggaagttgcagggatgagccactgggctctgtacagtcttgtgctgcccacatgctctagttgtacaaaggatactccctcaaacaagctctccccaaataggcctttgacgtctggacccagccaccggcccaaaagccgattagtacagggccagcagcatagcatccttctactacggcatgaaattaggagaggaagggtttgaagagagagagtggaagatgtggtttttattttttatttattttatgtatgtgagtacactgtagctgtacagatggttgtgaaccttcatgtggttgttgggagttcacttttaggacctctgctcactccagtcatctcccctcgctcagtccctgctcactccagcccaaagatttatttattattatacataagtacactgtagctgtcttcagacacaccagaagagggcgtcagatctcattacagatggttgtgagccaccatgtgggtgctgagatttgaactccggaccttcagaaaagcagtcagtgctcttaactgctgagccatctctccagcctgtgatttttatattttaggtagggccatagtatcaccagacaggtattccttgtatggctcaggatggtaaaattaaagttgtgcctcaggctcctgagtgggactgcatggctgctccagtatacctggccacctggattgttgactctgaagctcaggtcttagtttctgcctctgatcagttgacaaacttgatacctgcccagctcacaatgcaacctttgcatgcatcctggacttagccttgacaagggtagataggcaactgagtaggacgtgactggacttcgctgccatctagtgtgcaaatgtagtgcatgcaatgtccttgaactttttcttgccatgcctattttgttgttttatttgtttgtttttggtttattaattttttgtaggatctctctaatctgacttcttggaatttgctatataaactgggctggccttgaactcacagcagtcctcctgcctttgcctcctcagcaaatcctgccagcctatatacctccatg

SEQ ID NO: 2824 - DNA, 8708 bp, Homo sapiens
gtaaaggactggggccccgcaactggcctctcctgccctcttaagcgcagcgccattttagcaacgcagaagcccggcgccgggaagcctcagctcgcctgaaggcaggtcccctctgacgcctccgggagcccaggtttcccagagtccttgggacgcagcgacgagttgtgctgctatcttagctgtccttataggctggccattccaggtggtggtatttagataaaaccactcaaactctgcagtttggtcttggggtttggaggaaagcttttatttttcttcctgctccggttcagaaggtctgaagctcatacctaaccaggcataacacagaatctgcaaaacaaaaacccctaaaaaagcagacccagagcagtgtaaacacttctgggtgtgtccctgactggctgcccaaggtctctgtgtcttcggagacaaagccattcgcttagttggtctactttaaaaggccacttgaactcgctttccatggcgatttgccttgtgagcactttcaggagagcctggaagctgaaaaacggtagaaaaatttccgtgcgggccgtggggggctggcggcaactggggggccgcagatcagagtgggccactggcagccaacggcccccggggctcaggcggggagcagctctgtggtgtgggattgaggcgttttccaagagtgggttttcacgtttctaagatttcccaagcagacagcccgtgctgctccgatttctcgaacaaaaaagcaaaacgtgtggctgtcttgggagcaagtcgcaggactgcaagcagttgggggagaaagtccgccattttgccacttctcaaccgtccctgcaaggctggggctcagttgcgtaatggaaagtaaagccctgaactatcacactttaatcttccttcaaaaggtggtaaactatacctactgtccctcaagagaacacaagaagtgctttaagaggtattttaaaagttccgggggttttgtgaggtgtttgatgacccgtttaaaatatgatttccatgtttcttttgtctaaagtttgcagctcaaatctttccacacgctagtaatttaagtatttctgcatgtgtagtttgcattcaagttccataagctgttaagaaaaatctagaaaagtaaaactagaacctatttttaaccgaagaactactttttgcctccctcacaaaggcggcggaaggtgatcgaattccggtgatgcgagttgttctccgtctataaatacgcctcgcccgagctgtgcggtaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacaggtgaacaagctttttctgtatttacatacaaagtcagatcagttatgggacaatagtattgaatagatttcagctttatgctggagtaactggcatgtgagcaaactgtgttggcgtgggggtggaggggtgaggtgggcgctaagcctttttttaagatttttcaggtacccctcactaaaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctctaaa

What is claimed:

1. A modified oligonucleotide according to the following chemical structure:

(SEQ ID NO: 6)

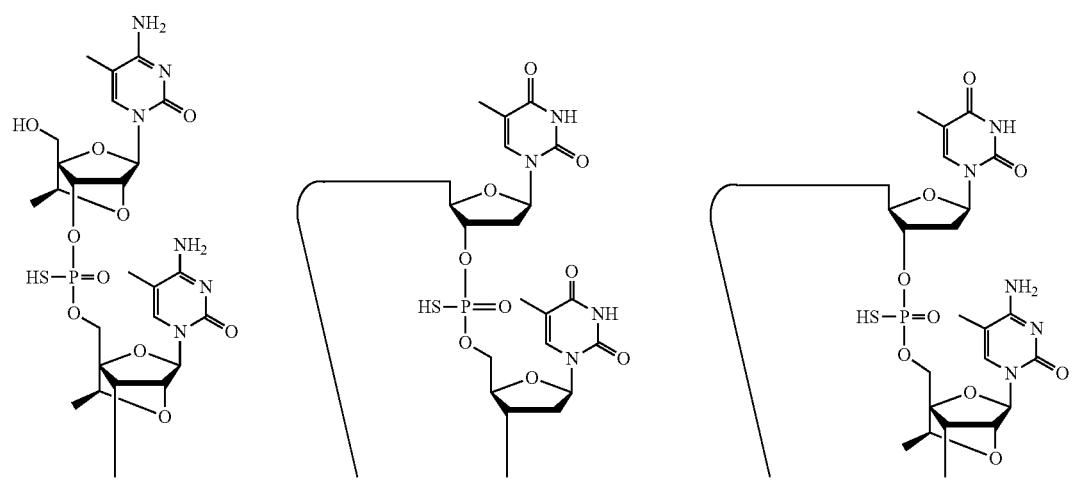

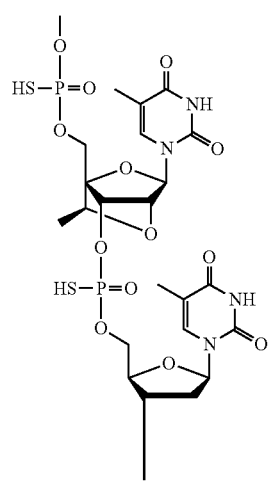
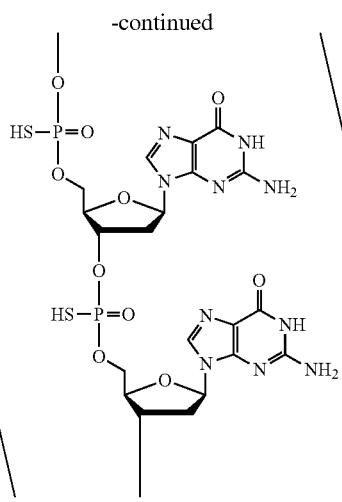
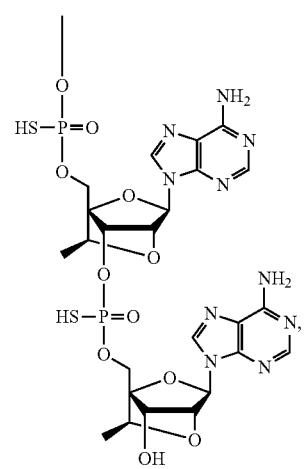
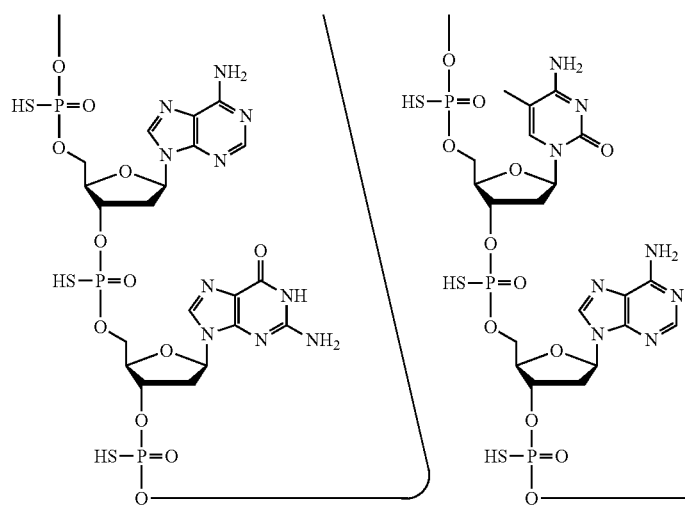
or a salt thereof.
2. The modified oligonucleotide of claim 1, wherein the modified oligonucleotide is the sodium salt or the potassium salt.

3. A modified oligonucleotide according to the following chemical structure:

(SEQ ID NO: 6)

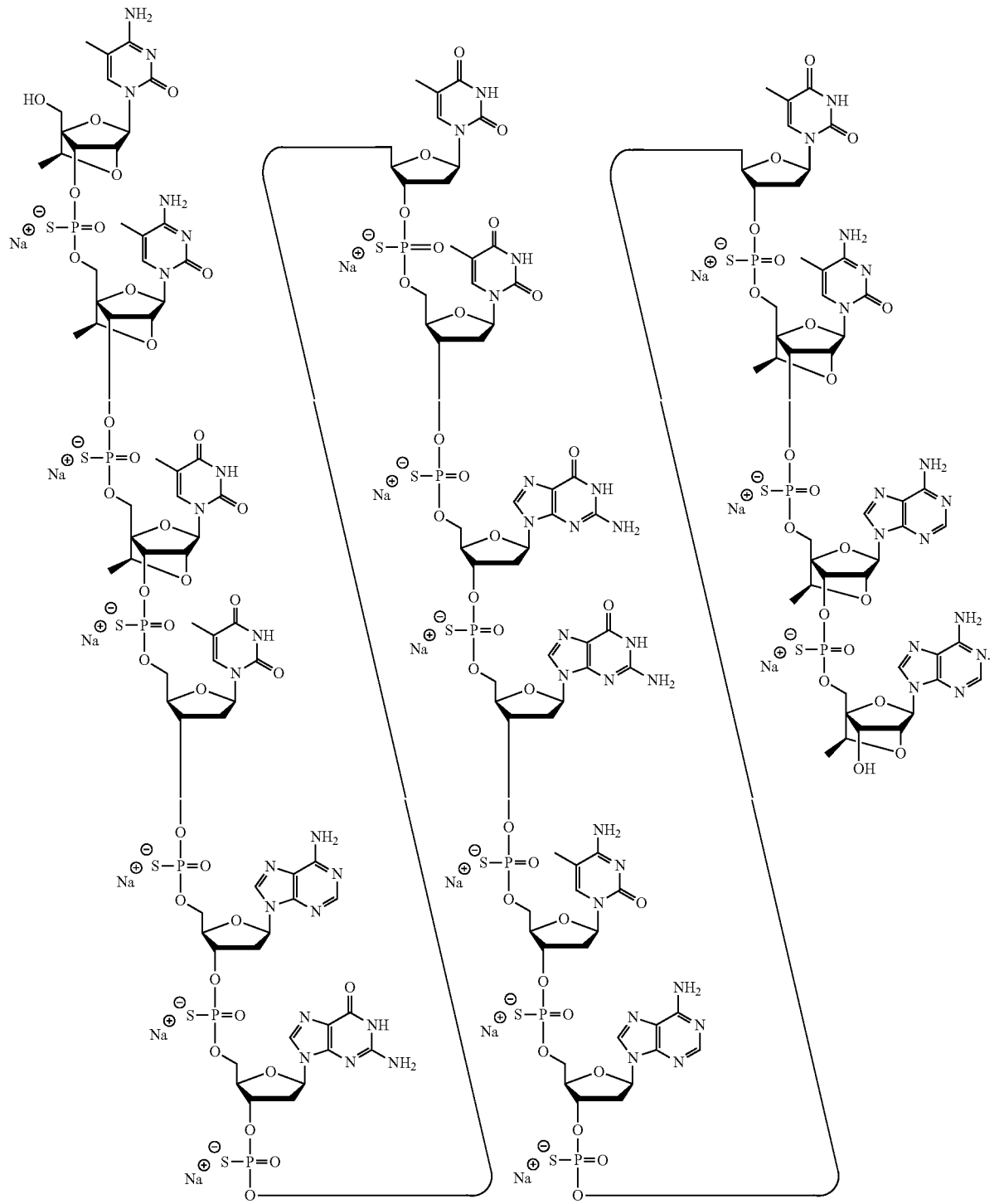

4. A composition, comprising the modified oligonucleotide of claim 1 and a pharmaceutically acceptable diluent or carrier.

5. A composition, comprising the modified oligonucleotide of claim 1 and water.

6. A composition, comprising the modified oligonucleotide of claim 3 and a pharmaceutically acceptable diluent or carrier.

7. A composition, comprising the modified oligonucleotide of claim 3 and water.

8. An oligomeric compound comprising a modified oligonucleotide according to the following formula: $^mC_{ks}{}^mC_{ks}T_{ks}T_{ds}A_{ds}G_{ds}T_{ds}T_{ds}G_{ds}G_{ds}{}^mC_{ds}A_{ds}T_{ds}{}^mC_{ks}A_{ks}A_k$ (SEQ ID NO: 6); wherein, A=an adenine nucleobase,
$^mC$=a 5-methyl cytosine nucleobase,
G=a guanine nucleobase,
T=a thymine nucleobase,
k=a cEt modified sugar moiety,
d=β-D-2'-deoxyribonucleoside, and
s=a phosphorothioate internucleoside linkage.

\* \* \* \* \*